United States Patent 9,254,311 (MODIFIED POLYNUCLEOTIDES FOR THE PRODUCTION OF PROTEINS) - sequence listing, part 3

SEQ ID NO: 2123 - DNA, 1894 bp, Homo sapiens
ttcctccttcacaggttctctttcctgctgagttgtgaagaaggtgcctgcttcctcttgcaccgtgattgttaagtttcctgaggcctccccagccatgcagaactgtgacaggactcagagactacctagacacatgcaaacaacaaaccagaggggatcgactaaatagttttcacttgagaaggcaatgggctactccactataagaaaaccatctgtatgaaagaatcttgatgtgctatgtggttcccgggtgcttcatctacatttgtggctgcactagaattaaatcaactcacttcaatggaaaaagtcaaatggtagatttgaagagtcagagttgggatttagagagattggaaaacaagccccctcctgctgtatatgatctagccgctaccacctcccagctgggggaatgggccaagagcagaatctggtgacaaagtagccttgggtggcttggttggccacacacgccactgaaagcacctctcccaggaatccagtcgcctccagtgcctgctgaagcaagaaaaccctccaaaggatgactccagctgtgtctgcatcataattaaggctgcaaaaacccaaaatgaatgaagtctccccagctaatgtgccacttctaatttaatctaattggcctctgaaagagagccttggcctgcctcagaggcaaaatcttccaaatgaagtgaatttaaactaatttaagctaactaattacaaactggggggtattgtcacaagacaattgttattgttctttgattgcttgctcaactggattatttgctcattaccttcagagctgttgggactttcatggggtgccccttgccgcacatcaataaggcattctacaaggcagcctggagtggagggtccccacaccagattggcatgggagcgctgaggattagcttggctttctgcgtgtttggagaatcttaaagcaaatgcacagcatgtgctgctcattcaaataacctgcagctaactacacctctttttggagacgtaagtttttctttagcttcgggatgtaggttatgagttttgaggtcatctgttgaaccaacctctttattgttcagtcgttctgaccttgagatgcagctcgttatacctgggtagagatctgaagcaaaagtggggagaaaaaaaagacctgtatccaagcctgtttctcagcagctgtgtgaggtagctgtgctgccacacctctctgagccacaggcagagatctggtggaaaacgcatgaaatttgcagacccatctatctgctgcttctggtttgagcttcagttccctcctcccaggcatgttaaatttagcctacagctgcctccttacttattttaagtgtaacaaatgttatgttacatttgggacctgtgtggctaaaggcttctctgcacaaagggaactgtcacttaactggatgtgaaaggggctgtaacctactcttgtgacaagcaaccatacttcaaccactcacaggtggccaagtcttccaactgtgttcgagtaaggccaacgctgagctgtagccaatcaggctgtttctctgcctcacttctgttttctgtgcttcactttccgttctctgcccgtaaagactctcaccacacggcagcaccagagacgctctgaacctcttctggtcagggggctgcctgattcccatatcattctttgctcaattaaactctgttaaatgtagtttgcctcagttttccttttaacaggcagaaactaccacctcacagaattgctatgaagactgaacatggtcactctgtgaaaacatttcataaactgtgtgtcgcttgcgaatgctgttatttttctcatctgtaaaataaaggaattcaaccaggg

SEQ ID NO: 2124 - DNA, 1167 bp, Homo sapiens
gctgaggcacatccacaaccaagagcctttcctccctgaggatcaacacctccccctgccatcctaagtcaaggtcttgacctaaggacttgtaacaaccaagccaaagcccagaggctacttgggaggctgaggcaggagaatcacttgaacccgggaggcggaggttgcagtgaaccgagattgcgccactgcactccagtctgggcaacagagcgagactccatcacaaaaagagaagagaagagaaggccagcaggcagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgct

SEQ ID NO: 2125 - DNA, 2931 bp, Homo sapiens
agtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggtctctacattggctggcgctgcccccattacctatgggactgtttccggattggggatgagtccagatgcttttgtggacacttgttgagagagcaccggatcatctcagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggctgttgctgcggctgttttgagtctaatttcctctgtgcggcctgtgaccggcgctgggaggaacacgagactttctttgacacccagaagacccggcaacgaggaggaaggcctcgcgggacagacactgtcagcaactggcacaggcctttgtgagtctggcccagatcagcaataaaagaggagtcattggaacctgacttggctctatatggggcaggtagatcccagcccagggagagactgcctaataacttagagttgacacctattagacacaggagaaagcctggatctggccatctgcctccatcacactcacattcaagctgcctgttgaaggaaagtggcttcaaggaagtcaagaagggaggaagtttcaagaaggatagagtgggaagtgatgttagatgcagttggggcaccaataagataaagactgaaaagtgtccattgggttttgcaattagaagatctttgggaacatcggagagtgcagtttcacactggtgcagtggaggcaggagtcaaacagcagtgagtttcaaggagtctcttaaagaagcttggatgaaaagtacaaaagtaaagtcagacaatatccagagggagttgtggagtcaaggaagtacttttgtaggaaggaaaaggggaagaggccagtagactaaaggaccttgaaggacccagaagagagagaagagatgcctggtgagacaagatcccagagatggaggaaagggatgaggtcaaagcagaggtgaagggattttctctggacaggagaaacaccacttcctatgaccaagacgaaggaagaggatggagccttcctagagtttcagggaacaagaacctgtggaagttcccctctgatggcttctatatgccctgtgaagtaggagataaggccaatggctggggtccaggggaagagggataagagtagggagcaggagacaagaagagaaaggggaaggtttgggaaggctaatgtagggaactggagaaaaacctcatcagtgggtagttcaggattcgggcacagttggaagtgagaacctagttagagaagcagagaatccaaatatttaatgggttgatgatgtgagggtgtcagggaggaagatcaggaaaactaagcaaaagaaggcatgaggatgtgaagggagcatacagcaccaatagggaaagaaagtgatgccaggaggcaaatgacagattgaaaaagggagcagtcaaaggaagagaagtctctaatgaggtacagtagcagacgtaggggcaggggttggagtacaagagacagtgttcagaggctgcagagcataacatctttcagatgagggcaagtgaaggtgataagtgcttgaagtagagaaaactgtgggccaaggatcaaaatcagtgaatgtgggaagtcacaagggagtccataggttcttatgggagtaggagattccagcactaatgggctctgtgaacccaggcaagtcactgtccctctttaggctgagtttctggacctgtaaaacaggaataacctctgtgttgcctactttctatgagaaccaaagaaataactaatttcaaagtgctttgtatcca

SEQ ID NO: 2126 - DNA, 719 bp, Homo sapiens
agtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagaggccgggcatggtggcacacgcctgtaattccagctacttgggaggctgaggcaggagaatcacttgaacccgggaggcggaggttgcagtgaaccgagattgcgccactgcactccagtctgggcaacagagcgagactccatcacaaaaagagaagagaagagaaggccagcaggcagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatg

SEQ ID NO: 2127 - DNA, 1154 bp, Homo sapiens
gcgcaggattcggagctcagaggcccgggccgccggccgcctcccctccgtggctctagggcggaggcggaggcggggaccggggtatctcgctcgcgcagcctggagcccatgctgggctcagcccgaccctgctttggccgctgcccgccgggtctccagcgccgccggaccctcacgccgccaccttctctccagcccagcgccgctgcggccgcagcctcctgccgagcatcttccagatcccaatccctgagaatcagttctgggatgtaacagagcaagcggacattattctgggaccagcaagcctcggtcactgcagccaccacactacgtggcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtccttgcccatcaacccggcccagagcggcagccccaaccacgtggattccgcctacttccctggctcttctacatcgtcatcttccgacaacgacgagggcagcggaggggcgacaaaatatacaatctattggggattccgtgccactgaccaccatgtacaaggaagggattcacaggcaagggggacagcagcccactggcatggggggcatgtctgctcacctaacgttttctggcggatttctcatggcccagcgcaacaactgacattccctactgagcaagcagctccgccagtgtgccctgccccagcgtcccgccgtctctcagcccctggatgagcccagggaaccggcactctactgaggacaaagcagggctcacctagcaatggaagctcttcaatacttaaggtagctaattcaatgtttgtaaaaggcatttacaacagaaaaccaaagattgaacttcagcttcagatttgtaaaccattcacatctctgcaacttaaaacagtaaataaagattatcaatgcacaa

SEQ ID NO: 2128 - DNA, 3409 bp, Homo sapiens
gtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattagataaatccca

SEQ ID NO: 2129 - DNA, 3184 bp, Homo sapiens
aaaaagaggcaaaggcagagaacaaaggaaggaggaagttaacttgtggaatgctgagaaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattaga

SEQ ID NO: 2130 - DNA, 3259 bp, Homo sapiens
aaaaagaggcaaaggcagagaacaaaggaaggaggaagttaacttgtggaatgctgagaaagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattaga

SEQ ID NO: 2131 - DNA, 1982 bp, Homo sapiens
gctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattag

SEQ ID NO: 2132 - DNA, 3815 bp, Homo sapiens
aaatgggtgcagagattcaggctggccaaggctggcacaaggacattcccagtggcgagagcatgagcaagggtcacggatgtgccaggaggggaggcggagagatgcctgggaccaacctctatggcaggccgcggcccaagggcaggggaggggtggacggagggaagggacagggtctcctccgggaccccagggaggctgggcccaaggaccatggagcctcgcagctgaatggagccccccaggcctgccttctgtcctgggaaccagggcctccctcgagccagagtcctgagcgccgcttgccccccgcccacagcggccccagcgagcgcgctgcagagggcgcgggtgccgtgactcagccgagcaccgcgatgtcagcggacgcgggaccggactggacacgaccgagccacctccccggaggccgcagcgccggcagtctcccaggatcagtcagccaagagacccgagattctcaaatcacggcagccgccagaggtgcccctgaaatcacagctacgccctagctcagccccgcctggaactgtgctccttttatctctgcccaaggtgagggaactcaggggaccttcctgctcctgccccgcccctgcccccacaacctttggcatcaaccactgtccccacccccatctcggggacttgctagtcctggggctgctgggaggggtacagccacaagagggatgccaagccagggcaatatgacgcccccacagcccaccccactggtctccagagaggcccagagatgtccagctgggcaggcagaggacagagaggctcgggcaggcttggcccagggcagagaaggcccaggtgcaggcaccctgagcacagatggccccccagcccccacccagctacccaggcctgggcgctgcagacagcgagtgcacttccccagagggccaggtggctcctcccacggcagtatcacccacttcccccagctcaccaccagctgggccctggtctcccaggagaatcttacacattgaagatgtactgtgctcagctctttgccggaagctaaagctcccaattgggccatcccaccccactctgccacctctgccatctaggaacccagatgcccggagaggaggtctgtcctggggcccttagtgtcttcccacaggagcccagcgcgtgcctgcaagggcctggtcccggaatgaactgtggatggaggctgctttgtccttttccccgtccagatccatgcccatagacaccgctgactataggctgggcccagggtcccttcctccagcctgcagcagaggggctttccaggctggaaagggaaggagtccttttgtccctgacgcaagcgggttgggggccagcacccgctccaggaagaggaagggatccagcctgaagtccagactccccgctccctctaagccagggcctggagcctggaggccaggttccttcttctacaccagcccacgttgggtgccagccaggctgggatggccctgcggggtcaccctgagccccagccaaccaacaccccactctcagccacagtgggaggccccatcagcctcttcacccaaccacgttgccactctgctgcacgggaccttgtgtggtcccaggcgtggccagacccagacgtcctggagatctcaatgcagacacccggcggcagttcctgcaggaaggaggctgtcctgccacgcctgcgggtgacccggcctctggtgccagagcctgccatccttcctgtttgtgctgccaggctggcagggtcccttgccaccgacctcagccgcagccacagcctgctccctccctgggtggatttgaaggagcctcccccaccctccgcccctagcttgctccttgaggaccctgggcagggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggctccccctcatctcaccccacccaggcctcctgactccctgggtttgtgcggacccaggcaggcagccaaccccagctccgtggtgtgtgagcatcgtgatgatcaggacacaagctcttccccgctgagccttcactgtgggccagcttcccggtggatgcccactgaagaggcctcaacccagtgggccccactccagaccaagagcagaccattggccagctgccccctgcagacagcggcacccggggcagcagcaaggtgaggggcacccagccccagccccaggggcgtctcagggagcgggctgagcctggctgtcttcctgagccccacctgcttcatgggttggcttgagcaaggcagtccagatgcgtgtctcgagcgctccctggcggcatgctgcaaagctacatggctccggcaacaaggaagactgcccttattctcagtaacaggtggagctgggggctggagagcccctcggacctcgccttgggaaagctgggtgggtgcacggagcctggcaggtggccaaggggacccccaagtggagggattggtcgaggggcagcacagggtggtgcagtgggtgagctcagcccctcccctccaactctcatcccattgagccccaaggcgtggggggatcacgtctgtccttgttctcctccaggtggagctgctgggtggggctctggtcctccagggacccactctgcaccccaagttttgccgggacccgctcctctgtgttgtgtggctgtaggggagggctgcagccagggactctgaacccggggccggcccacccagccacccagggtggggaacaagatcgcctcccagggccagaagctggggatgtccttgcttcctaggatgttggctaggggatcacacgccccacattctgggtcaagcatggtcctgccccagcatcttgctgggttgggggcatctctgcacagatgagtgccaccccagcgtctccgccagggtctgggcatgtcactcttgggcatctgtgctcaggaggtcaccaggtgtgggcagggcaccaagcagggaggtagccgaggctggaagatgcacatcagtgccccgctgggcttcctcaagtgggaactggtggagggggcgctaggctgccgggccagggtcagcaggctcaggccggctcagggctcagagttgagccagaaaccaaggtgaaatctgcctcttactgccgccagggcccttgggacagggacaggaacagcagaaggtaaagtggaaaggaattgagtaatgggcccccaggcaaggctgagccaggccccaagcccaggattggggtctccagagtccctgggggccccagggcagctcacccacagcctggggcctatgggagcaagggggctcctgatgggtgggggcaggagcttggacaaagttgaaggccttctgtctgaattggccaggggccaatgaaagccaaaaagctggtgtggtggcttatgcctgtaatcccactttgggaggccaaggcgggtggatcacctgaggtcaggagttcgagaccagcctggtcaacatggtgaaaccccatctccactaaaaatagctgggcgtggtggcaggcacctgtatgtaatcccaaatactcgggaggctgaggcaggagaatcacttgaacctgggagatggaggttgcagagagccaagatcatatcactgcactccagcctggctgacagagtgagaatctgtctc

SEQ ID NO: 2133 - DNA, 978 bp, Homo sapiens
acagacacactccgtcccacccaccaccagcgctctggagcctgccccgggccagggaacagcttggcctgatcctgctgacgcctcagggcaggacagggcagggaggctccaggcggccacccatgctgggcacacagtggactctcgcacggtgtcttctgccgtcacaccctgacccagggctggccgggagccttcggggcgacagctccgaggatggacgtaggggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcggggacccaccctgcaaacgctgggccaggacccctgtcccggagaagcagccagctcagaacccccttggaggccgggaggaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggccttgggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccaggagaccat

SEQ ID NO: 2134 - DNA, 812 bp, Homo sapiens
cgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttgga

SEQ ID NO: 2135 - DNA, 387 bp, Homo sapiens
tctcaaaaggccacatgtagaatattcaaaaagtgttgaagtttcaaaaatcttctaatattttaaatgcctaatagacataaaacaaaagaccaaactctcctgcctgctcagcagtacatatggcttttgaatagccacactcaaatgacagcccctgttccccagttcaaactttctgagactgcaagcctactttgcaagaggaaaatctccacagctatgtcatctacctgcttatagggtgtaaaattcaatctatgactaacaaatcaatattgtaaattatattacttggatactcatttgtcttacatttatttatttagcctgctctgtgggtcaaataagaggagaatcttaataaacagtcttactactattgaa

SEQ ID NO: 2136 - DNA, 561 bp, Homo sapiens
cggccgccccccacacaaaggggctccccgcctgggtcgcggcgtcggcgcactcgtccccgccccgcgcgcgggctctcacccacctgcaggtgtctgtgcgtctgtccataggaacgcggtcggcgcgggggggcctgcgagagccgggcagcccgggctggacgggacgggccgaaggggcgcgagggcgggaggagagcggccagagggccgggcaccaaaggtgtggaacccgccgtccccgctatggtccgaggaagtgtacagcactgctccctactacacgtcctgggcccgcggtccccgatgccccccggagctctgtgcacctccactgaaacgcaaggagcagacagaacctacaccatccgtgaggcatccaaccatgatgaggtaccttgttgaacaaactaactctgccactgagaacgatgaaagctgtttaaaaaaataaataagtctgtttaaaacaattggagagcaaccctgtcatccaaggcttgagagtccacgagccccccaggaagaagagaaatactctgaagtgagtcctgcatt

SEQ ID NO: 2137 - DNA, 1753 bp, Homo sapiens
atgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggacccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacagttaa

SEQ ID NO: 2138 - DNA, 2717 bp, Homo sapiens
cagagcgcgagcttagcactccccagccccagtcccagctctgccaggaaaggggagacttcaccgtggcactgggaattggattctaaactttaggatcaagcaatggaaggacctggaataagacaccttcttgacccccctgaagggctctgagcagctgggcttgcctttctctttgctcccccagtcctccccttacttctcggtctcccactccccatcactcctttccctgcctcctcctgcctgtctccatcttcctccctctctttcttctctcgccccattaatccccgcttgtcactatcacctccttcctccagtctttcccccttcgctgccccttctttcctctgacatttccttctcctcttactgccactgtctcccacctttctcctcccccacatttctccctatccctacctcctcttccccttcatctttctccttcccccttatttttctatctccttcctcagtcccactcctctttccaccctccttttgcccgtcacttctccttctccctcactgccccctccctctctctcccctccccaggtcctgccccacccagctgtgtttgcttttctcccggatccggatggaggggttgccctgcccgtgcccagccctgccccacttctggcagcttaggtctcacttaatggctgagggctccaggactcaggcccctgggaaagggcccccactcagcatccagttcctgcgagcccagtatgaaggcttgaagaggcagcagaggacccaggcccacctcctggtgcttccaaaaggaggaaacacacctgctcctgcagaatcgatggtcaatgctgtttggattaacaaggagagaagaagctcactgtccctggaagaggcagattctgaggtggaggggaggctggaggaggctgcccagggctgccttcaggcccccaagtctccatggcacacgcacctggagatgcattgtttggtccaaacctccccccaggacaccagtcatcaagtacatcataggggcaagcttgtgggatctgatcaaaggctccctcctgaaggagacacacacttgtttgaaaccaatcagatgactcagcaaggaaccggaatcccagaggctgcccagcttccatgccaggtgggcaatacccaaacaaaggcagtggaatctggcttaaaattcagcactcaatgtcctctttccataaagaacccacacaggtctggcaaaccagcttactatccatttccccagaggaaaacacccaggatctcccaagctgcccggaacctgggcttatatggctcagcgtgaagctttctattctgccagatgtcttgaccttgaggccacctatggccttatagaagaaccaaggaggcagagccacaacgaggtctctagctatgagcaagaactggactaacctaattataggaattgtgggagacgaacttcacaatggtaacatggttttacccttccaataagaagagacttcccaggccaaattgcccacagtttaggatgaagaggactgtctggtcagtgcagccccattctgacattactatgaggtcctggatatccattccttggggaggaccagtaagacatctgctccatccctggaactggataattttggaacataaaccagggacctagccaacagaatgccttagcaatgcccaggggtcaatgggcgtggcattcttgttttcaatgtcttctgatgatttctcatatattctggagaagacaagctctgagaattcagatgctttttctggtggctatgtctggggggccatctcacttagaagtcacaacactcattggcagtgatcacatcatttcaatttgggcttcccaaagtatggtcacccagggtatgaaggtgagatcaatgctacctaccattttgtgtctttaaggggtctttagaaagggctaatcatctgtcactgctcactgagacatgtacattccagcatcatcacagagttatctccttccttccttccttccttccttccttccttccttctgtctctccctccctccctcccttcctcccttctttccttctttctttcctctcttccttcttgccttctttcctgccttcctgcctatcttttctctctctctctctctgcaaattaagttcttattaaaaactgccaatcattgacgatatataatgatgagatcctgaacaaaagaggcaaagaaatgctcctacttgaaaaatacacattccctatagactgcctcctgtttagtccaacttagatcactcagatccttcctgggatcaaatatatttttaaacctaagacaaagcgaagcaggtgtcacttgggtgatagggaaaaaagcttgtatttcctggttaatgtttagcttttgtaatgctatttaaacacacctaaggtgcctttccctcatctcaggtgctttctctgtaaagtttcactcccacctttcttttctctgcatggccgtccagtcttgcccatctacatccagagctgttaactagtagtgtcattacctgtgaaaaacatgtagaagcttccttgaaccacccagaaatccactcaaatttggggattgtcattccttttgtgaataattaatacaattcagttgttttttaaatattctaataaaaaaggaaattttctcaaaaaaa

SEQ ID NO: 2139 - DNA, 801 bp, Homo sapiens
ggggctgggccttggggctgctggatgaatgagacccagcctctgccctgggagtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtaaaattaagccgttaatacagagcaaaaggtccgatttaatctgctaacgtgagaa

SEQ ID NO: 2140 - DNA, 409 bp, Homo sapiens
gtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcagtgtcaataaaatgaacaagcctggaaaacatagaaagaccccatctccaaaaataaataaataaataaataaataaataaaaatta

SEQ ID NO: 2141 - DNA, 3635 bp, Homo sapiens
gggcacctcagcaaccagtagccatgcgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggaaggtctagtcatgccaaatggaaaaagaaaggaaggtctggtaaaggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggttgtagaagttttaaactagttttaactgtgtgttcgtatataacctagttacgcatttatggaaagcattccattctgacctaacagatgcatttgttatagaggcagcagatgaaatggcaggtaaactaggagtcaagagaccattccaggcttcagcctgctggttgtgaagtgggcaaaggagaaggacctgcttcctctgtgattccacagaatattttgagaatcttgtaagagagaagttctaaaactactttttcaggctattggacactaaatagatgagagcagttattttgcttgttctttcccagaacttgaactctcccactggattgtactcaactgggccttaggtagttttctcagaaaaattcagtagctgatccaccttgaattttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggactactatatccctggaacagaagcaccagtgatacaaagatgagttggtcccagcctgtgttaaggggcctgcctgcgtctagggatgaagactctaagcaggtcactaccctaccgtggggaaagcgctctagcagaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagat

SEQ ID NO: 2142 - DNA, 843 bp, Homo sapiens
cgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacag

SEQ ID NO: 2143 - DNA, 2971 bp, Homo sapiens
attttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggactactatatccctggaacagaagcaccagtgatacaaagatgagttggtcccagcctgtgttaaggggcctgcctgcgtctagggatgaagactctaagcaggtcactaccctaccgtggggaaagcgctctagcagaggtttgtgcacaggcttctctatggggactgtaggaaagaatgcttttgtctggaggagccagaaaggctttgtaaaaggtgtgcttttgagggcctcaaagagcaagtaggagtttgataggtagagaagaggatgggctaccaggtagcaagaagggtgtgtgttggtactaggtctgtgtgagagaattatgagtaagtgcagtgaggcgtaagcagacagtgttagaggattctggggcgtgactgtattctccaagtgtttgcactgttcttcatttttcacgtttttatgtcataggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatc

SEQ ID NO: 2144 - DNA, 1647 bp, Homo sapiens
actgcgcatgcgtcaggcatggagagcggaagcggaaggttgaatgcgtcgggtgggcacctcagcaaccagtagccatgcgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatcaccaaatgctttttgatctgttgatattaaagaatcaaaaggtga

SEQ ID NO: 2145 - DNA, 552 bp, Homo sapiens
ggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtaacccatttcatttctacttttacctttttcctcacccaaaaaagccttataaaataaacagcattcaccactggctgtttattcagacgagtaccaatgatgttaactcctgagaaccaccagacattgaagaaaatacaatgatt

SEQ ID NO: 2146 - DNA, 713 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaccgc

SEQ ID NO: 2147 - DNA, 2572 bp, Homo sapiens
cgtctgccgcctcaccgcttggccccgcccctcgccacctgcccggccaggcgcgccggggccgtcccagtacgtcgccctgtttacgctggctctttctcccagtcttttttcgttttaagatgtgagaagagatgggattcttcaatcaaggccacaagcgggaaatcagtctgcaggaccgatgccagcaggctcacgcaccgagaacggctactccgcccagctgagaagcgcggggccctgacgcgggcgcgctcctcgcattcttccgttgggctgggaggctggagggcaggcggcggcggccgcgcatgcgccgggagcggccggagctgcgggacgcggagggccgactgcgcctgcgcgctggttgcctggttacggcgtggccgcgggcaccgagcggcgccggaagttggtcgatggctgccgccagtccctggccagcgtcctggggtttccccgacgcatcctctactgtcccttcgctctgcacagaggcccgggcagggaggggcggcccggccaccgcgcggagccgggtgtccgccgactcgcaagggggacgcgcgggctcctcgtccccaagctccgccctgcgcctttgctgcgccgggccctcccaggcccaccctggccccagccctgctgtcctcccggggaggtgcggcctactcggttcgttcccccggccgccagccccacaggggcgctggggtcccagccttggctgagtgcacgtcggtggcgagtgggcccgggcgctcgggcggccagagcgacccagcggaggggtgaggcgggtaggcgctcctgtgcctgccacggccaggccaggcagcatccacgccctcccgcggaagatcgcagggaacaggtgggcactatcctctgtgccctcatttttcggaggagccgagggaggctgagcggttgaggaagcggccagccatgccgggcccactcacctgcacacctgcctggcaagggcagggaagagccgcggccttcctctgctgctccttccagagggcaggcgccgtggtgggggtgcccgcccgatggcatcgcgggaggctgagctcccagcagcggctgaggtcctccctgggtgggagccacccttgtccccagctgggccggcggctggtgagggagggggtgatatccgtgccacgccagcagggccgcaggcggtgcagggagagcttcagtccggctgacgtggcaccagggccaatctgctcagctaacatttgcctttcaggagtcagattcctgacctgtttgaacagagttagggagcacgtggtagggcccagccccagccccgctgcccccatctgcttcttcccagtggtcgaggcgctctgcaccctccgcggaaggaggtgtcattgtttgccctttccaaagagggggatgcagaggtggatgctgcctctcaggcgtggggctcgccttttgccgctcgcgagttcaaagaacccaagagccaggagcccagggctcgaccctctagggtcctccgaaaccctgtggtcccaccggggtgggcactaagctatgggagagaccatagctgcagaaaccaaccctgccctaggcataaaatgcaaggtctctggacctcagggcagggatgttagacagcggcttctgttggctcctaggggtgtgaatcaccacatcacctgcagggggcgcggctgtctttcttccccctcttctccctaatcctgagtgcacggagacagctctcagcagtttgtagcctgatgtggagtggagggttcctgcaccctacacccgagcccatccagcctctgggccatagacccttccgttgaaggcccagcctgcccctgagacgctgtgtgccctttttcaacttccttagtctctgagcatcaggtcttcatctctaagatagagcaagatgagcacctaaacgtttcagggctgaaatggggttgccaggacaacaagcatggcaggggcgaatggggacatcaggtgactgactgcgagccagcagaggcctccacccagtgctgggaggtgtcccgccggtggtggccatcactattcctggtggggctttgctgcttttgcctgcagcatccgctggtttctccattctccaagtctctgcccctgctcacacctggaggctggacacaagtgtcaccacttccctgaacccccctaggtgggctggaatcagcatctggtgcaaagctctgtgaccactgctgtaccacattatgcagagcacacaggacaggctggtgcacctccaggctgtgccaggaaacccgctgcctttgcgtcaccacagccttggtcacagcgtgaccttggtgcctccgacgggtcagctcctcccattagccatgctgtccagcacgggggccgctggtgcttgctgtgagactgagctgggctctgagtgtaaactacatggtaggttgtgaaggatgcaaatatcgaatcaatcattttttattgcatattaaaatgacaatatcttggatgtatcagattaaacaaaatactatttaatttt

SEQ ID NO: 2148 - DNA, 739 bp, Homo sapiens
ctcagaagaccgagaggacagactgccgtgttgccaccacaggctggaccatggacccccaagagatggtcgtcaagaacccatatgcccacatcagcatcccccgggctcacctgcggcctgacctggggcagcagttagaggtggcttccacctgttcctcatcctcggagatgcagcccctgccagtggggccctgtgccccagagccaacccacctcttgcagccgaccgaggtcccagggcccaagggcgccaagggtaaccagggggctgcccccatccagaaccagcaggcctggcagcagcctggcaacccctacagcagcagtcagcgccaggccggactgacctacgctggccctccgcccgcggggcgcggggatgacatcgcccaccactgctgctgctgcccctgctgccactgctgccactgcccccccttctgccgctgccacagctgctgctgctgtgtcatctcctagcccagcccaccctgccagggccaggacccagacttcagcaaatgtggctcacacagtgccgggacatgccgggacatgcggggtggctgttgtcatgggcgtctgccccttcacaccaggcactggggctcagacccaccaggaaggtggccgttcagcccgagctcctgaaacggaatcccaggtcctggctggagagggacacccctgattaccttaaggcccaggcaataaagcagggtgatcttcctccc

SEQ ID NO: 2149 - DNA, 3239 bp, Homo sapiens
gcggcagccagcgagaggggagaaacagattcacacccaggggcctccgggcagggcccacgggactcaggccgtgtcccgcttggaatgtggagcaggcgcggcctcggcgtcagcagagctcccctgcatctcctcctgggggtgtgggggccgagtgggagaactggcggacagaggaaaggggcctcgctcgcaaggcccgggcggggaggcctggcctcctgctcagtcggtgcaaatggaaaaagagacgttctgtttctccggaaaaccctgactaatacagtagaggatatccagattgacaacttcaggagaaagtctgatttaggagtcggaagcccagattggaaaaacctcttgatagatgtcactcgggaagaccatgaaaacagccaaaataattcaaagagaagatgcaaagtgaactgtgaaacagaccaaagatgaatctctttggtaaatcccctgcctaaatcccctgccatggaatagctgcctaaacttgggcaaataacttgacatttctcagtttccacattccaaaaatggatttttatgagaattaaatgttatgatgcattccagctacctgtcctagaacctggcataagagctcagtacatgctggggagggttatcatcatcgtcatcatcatcttattaacattcatgttgaagggatgatgggctgctgagaagttcatgaagaaggtgaaaaactattacagaggtgggaggaaaaagagaggactatcacagaagcagaagagctgagagtattgagaaagggtgacgggttagggggactagcaagtaccctctggcgttggcaatattcagtttgttgaaggccttgatgaactttaatgaagtggtgagagttaaacaaagctgagataggatatgaatctcagggaggatatgaggactcattgattaccattccaagaaacttgtctgaaaaggaaagaagagatggtggtaatcagagcagagtggcaggatgcagggagtttttatttatttatttgttcttgttgctgacattgttttcatactattttttgtttgttaaagagggagagttgtgagtataaaataacctataaatagggaaaaccaggaacagattcatgtgaaagcccttgactgagaacagaattaattacccgtgcagaggtagtcttcaagccttggcaggtaagcaactgtctgagacacagctggctcgggaacagggcctttctttggctggcaggcttgaggcagcataatttggaagcggatatgagaaagggcataataatgtgaaatttgactgcctagtgggggagaaactttgaatattatgaggcggttatgaaagtatttccttcttatggcttcaatggcactgcctctgagcattagtgtttgtcctcaggaggtaagtgtggggactgtatcagcagttactacctagataagcacggtgtataggggtaacatggtttatagagcatgcaagccttcacctctttgctagatgagatatggaacctaaattcggagaccacgtgacccctgaggcatggggaggtggggtcagaaagcgttactggccatgatccagacccaggcgtggagaaacgacctactggggttttcagggagcaggaaggtggggcaggtacagagtatattctgggggacagtttcataaaaagtgagtagatctccacaacttagtttctagactaaatggactaagcatgttccgccctattcttcctactaacaataacaaaaagctctggacaaaatttataaagcaacccacagaagactccgaagttggaaaaagaaataaaaactggcgatttcctccatactcaaggcatcatgtagcagggagtgccttgggtgttgtttatgtgtttgttttcttttgttcattaatttttttctcccgtgtatggcagtgtgggctctagcaatgcctaccacccggaaacacagatgggtacaaatttaaaaaccccaagaaaactctttttagccaaatgaccagtgtttccagcagagcaaaaacattttgaccacatctgcccttttgtgctggctaaccccttcccctgccaccatgtgctgctggggggacattgtggatgaagcccactcatttattcctcctcctgcagtaatgtgaccatacccttcccactcctaactagaggctgggggaggactatgtgggggagagaactggagaaagcaattttctaaatttgtgtatgaaatcctggttagaactctgagtgccccatgcacaaaacagacaagaaacaacacagcaaaaagattcaagggtcagaaaaactgaacactggtctgaaacactgcccgggtttcagattggcatcagggtagcacccaagtggggcagattgaaatagcactgtaaaggctttgaaaatgaaatgacttttgagccacagctcacaaagtgaaccggaacaagcattctgaacttaaacaggtcaagtgcctgctaaaatcaaagactgaaatgggaaccagaataatataacatactactgaaaatgtctaggatgcaatccaaaatctcatcacactgaaaaccataaaaatctcaacttgaaagagaaaaggcaattgtaagcattgagattacacagatgttgaaactatccagcaagaatcataaagcagctattatacaaatgccctgattttaaagcaagtatgaatgctcgaaacaaatgacaaagtggaaagtcacagcagagaaatagaaaatgtaaggaagaaccaaatggaaattttaaaactgaaaaatacaataaccagtttttaaaaattactagattcagagggaaagaccaacaactcagaaaaaatgggcaaaggatatgaagagtttacggaaaaggaaatgtagataactcttacccatataaaaatatgttcagcctcactcatataagaaaaatcaaaattgaaattacactgagacactgcttttcacctgtcagaatggcaaaactcaaagtgtgaatatacgctatgagaatgtggaaaattctcatagattgcttgtgggcatctagaacaatttggttgaatcactaaaatccacatgccatttggccctgcaattctacttttagaaatttatcatataggaaacctgcatatgagtgaaatgacatacgtggagtgttactcctggc

SEQ ID NO: 2150 - DNA, 1818 bp, Homo sapiens
aagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggctgccggcccggcctcggtgggaacctcttattctgtttatgactcctcagcggtgcagaaagttattccttcccttgctggacaccacatcaaaggaggcccacaggctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacggccttccacacccttctttgatctgctgcagcaccggtacctgcagctgtgggtacaggaacaaaaggccacccagaaagccatcaaactggagaagaagcagaaggtggtccttgggaagctgtatgagacccggagcagtcagctgaggaagtacaagccgcccgtgaagctggacaccctctggcacatgcctcacttccagaaggtgggccgccaccttgatacgttccccacggaggccgatcgccagagagcattaaaagcccaccgggaagagtgtgccgtgcgccaggggaccctgcggatgggcaactacacccacccctagcccctccctcccctgccacaagaagccatcttgacatagtggaaaattcccagaaggactccctatcttgccccaaccctgacattcccccatttttatgcaggttctgcttcaaggagctcagattcaagtcttaggctaattgtttttggtaaaagtccccccttttaggttagccaacattagtctccacttagccccagtgaccctctacctggagcctcctcctctcctcctccttctcctcctagggcaggctcaccctgcctcttctcaagccctcacctgccaagacaagcccaaattacaagacaattttttagactccaggctaagggtcgattccatggctctgcccattaagtgttaagaacgacctgtgtatttgctgcagaaagcatgacagtgacgtgctttgaaagccctcattttctattccaaacatgagttttaattgctctttttgggatgcctgatgtctcatcacggcagtattatctctctgggacctctgacagcaggaagagccaatggttcattactcgagcctgcccccgcctcctcagtgctggggccccgtcaatcaagcaggccaagttggactcctcccccaggactgactttggaaggtcaacccactctggaaaaagccttccaggccagcgggtagactgctgaacacaggctgctgagcttctcagccgaattcctggacacttcctcactcggtctttccgtgtgttctttggattctctctgaaaattttatgctgatctattttaaattaaaaatgctatttgtcatcc

SEQ ID NO: 2151 - DNA, 1638 bp, Homo sapiens
gcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacggccttccacacccttctttgatctgctgcagcaccggtacctgcagctgtgggtacaggaacaaaaggccacccagaaagccatcaaactggagaagaagcagaaggtggtccttgggaagctgtatgagacccggagcagtcagctgaggaagtacaagccgcccgtgaagctggacaccctctggcacatgcctcacttccagaaggtgggccgccaccttgatacgttccccacggaggccgatcgccagagagcattaaaagcccaccgggaagagtgtgccgtgcgccaggggaccctgcggatgggcaactacacccacccctagcccctccctcccctgccacaagaagccatcttgacatagtggaaaattcccagaaggactccctatcttgccccaaccctgacattcccccatttttatgcaggttctgcttcaaggagctcagattcaagtcttaggctaattgtttttggtaaaagtccccccttttaggttagccaacattagtctccacttagccccagtgaccctctacctggagcctcctcctctcctcctccttctcctcctagggcaggctcaccctgcctcttctcaagccctcacctgccaagacaagcccaaattacaagacaattttttagactccaggctaagggtcgattccatggctctgcccattaagtgttaagaacgacctgtgtatttgctgcagaaagcatgacagtgacgtgctttgaaagccctcattttctattccaaacatgagttttaattgctctttttgggatgcctgatgtctcatcacggcagtattatctctctgggacctctgacagcaggaagagccaatggttcattactcgagcctgcccccgcctcctcagtgctggggccccgtcaatcaagcaggccaagttggactcctcccccaggactgactttggaaggtcaacccactctggaaaaagccttccaggccagcgggtagactgctgaacacaggctgctgagcttctcagccgaattcctggacacttcctcactcggtctttccgtg

SEQ ID NO: 2152 - DNA, 2931 bp, Homo sapiens
atgacccgtacggaccctccggacctgctggtgtcgaccgtgtaccaggacatcaaggtggcgaccccgggacccgcgtccaagtgctcgccatgtgagcgatccgtggcccggcctgctgagcccgcgcctttcaacaagcgccactgccgcagcttcgacttcctggaggcgctggacgggccggccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggccgcgcactgggcccgccccgccccgcagttccacggcctcacggtgcccgggccccgccacatggcgctgtcgcgcaccccgacgcccagcgactcatactgtgcggatccccgggcgttctactgcgacgggcccctgcctgggccccgggactacgccgagcgccgcagtctgcccttcaccaccccgccgggccccacccagttcttctatacagaggagccccaaggcttccggggcagctttgcagccagtcccggcccaaccttcgacgcctactaccccaggccctatccgtccgaggagctctcggggcccagtccaaggcgcatgggcggctactacgcaggagaggtgcgcaccttcccaatccaggaaccgccctcccgctcctactatggggaggctccacgagcctacggcctgccctacgggccccgctatgtccccgaggagccccgggcccactccaccgcccgccccttttacacggaggacttcggaaggtaccgcgagcgtgacgtcctggctcggacgtacccgcacccgcgcagcagcccggcctgggcggactggggcccgcgaccgtaccgcaccctgcaagtggtgccgccctctgaccccgacccgttgctcgcctcctggcacggcggcaccggcaccagtccgccccggctggccaccgacagccgccactactcgcgctcctgggacaacattctggccccggggccgcgccgagaagacccgttgggccgcggccgcagctacgagaacctgctggggcgcgaggtgcgggagccgcgaggcgtgtcccccgaaggccggcgcccgcccgtcgtcgtgaacctgtccacctctcccagacgctacgccgcactgtccctgtccgagacgtcgctgacggagaagggccgcgcgggcgagggcctgggccgcaactggtacgtgacgcccgagatcaccatcactgacaatgacctgcgcgccaccgagcgcccgagcgccagggcctgggagttgcccgggggccgcacgcggccacctccccacgcggcccccgacggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaacccagcgccgacgaggacgacctgatgacctgctccaatgcgcgctgccggcgcaccgagaccatgttcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcgcggagccgcgagcccgacatggagacgctgatcctgacgccaccgccgggcacggcgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgcgcgcgctcgactgggtggccagcgccaacctgctggacgacatcatgtga

SEQ ID NO: 2153 - DNA, 1206 bp, Homo sapiens
ttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggcccgccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccg

SEQ ID NO: 2154 - DNA, 1173 bp, Homo sapiens
gagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggcccgccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccg

SEQ ID NO: 2155 - DNA, 1092 bp, Homo sapiens
gacagagcggacccaggccctcggccgccccgcgtcatggccgcgccggccccggtcacgcggcaggttagcggcgccgccgccctggtcccggccccgagcggccccgacagcgggcagcccctggcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggt

SEQ ID NO: 2156 - DNA, 2863 bp, Homo sapiens
atggccgcgccggccccggtcacgcggcaggttagcggcgccgccgccctggtcccggccccgagcggccccgacagcgggcagcccctggcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 2157 - DNA, 2514 bp, Homo sapiens
aatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 2158 - DNA, 2723 bp, Homo sapiens
aggccctcggccgccccgcgtcatggccgcgccggccccggtcacgcggcagcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 2159 - DNA, 1092 bp, Homo sapiens
gcgcgccatcttggctccggatcgtgcgtgaggcggcttcggtgagagccggaaccgggcgggcagaggggcgctcgtagggttgggggacgcctgtggcttggctgcagcggccggcaagaccctggaagagaccgtggctatggaaacggccaaggctgtcttggaatgtcctgagcagccctccgagtcgagcctctgcccccgagtttctgagtgacctgggttgatatagattgaccttgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttgatgagcctct

SEQ ID NO: 2160 - DNA, 888 bp, Homo sapiens
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttgatgagcctct

SEQ ID NO: 2161 - DNA, 648 bp, Homo sapiens
cgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactgtaagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 2162 - DNA, 496 bp, Homo sapiens
ggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcggatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 2163 - DNA, 596 bp, Homo sapiens
gctgaagggcgggagaagttgcggcgtggcgataggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactgtaagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 2164 - DNA, 712 bp, Homo sapiens
tgacagccgccaacacagagccctggagaggtggggagctgctgaagggcgggagaagttgcggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 2165 - DNA, 376 bp, Homo sapiens
tgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggtatctgttgcacccagcacagacgtctggggactgggacacgcataccccaccacctcccaaactacagtgactgatatttca

SEQ ID NO: 2166 - DNA, 3588 bp, Homo sapiens
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaac

SEQ ID NO: 2167 - DNA, 770 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacaggtgtgtatgggggcttgggggtagctgggcagcccaaaggaacctgtatagcacaagtgggctgtacaggccacacctgctatattgtcagaattgggatattcttcagccagaatctctccaagggtgaattctcc

SEQ ID NO: 2168 - DNA, 3591 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 2169 - DNA, 3543 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 2170 - DNA, 893 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaaccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 2171 - DNA, 3573 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 2172 - DNA, 3624 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcca

SEQ ID NO: 2173 - DNA, 798 bp, Homo sapiens
agctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccac

SEQ ID NO: 2174 - DNA, 3644 bp, Homo sapiens
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggagggtgagtcagtagccatgaattacaaaccatccccgctccaagtgaagctggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagcc

SEQ ID NO: 2175 - DNA, 873 bp, Homo sapiens
gggcttgcctcctcctgcgtcctgctagctatttttaaatgtgagctctattttgttccaagatcattaggatatttagccccttcaccaatttccacaagaaaattaattcattccaatattcagaggttccttttttatttcttagccagtgattaaggaatccattatgtaacccagagccattctctctactcttttcttaatttttccttctaaaatggggagttccattttcttaatttttcattctaaattggggagttccaaattttttttctctctctctcttaggcaaagcagttcatgtccttcctggaagttttagtatctgccagtactgatgcccagtttgcattttaaaagctccttctagctgctagatgctgaaaagactgaaaggaggcaaggggataggcaaagggaccagtatcaggttattttaggagatgatggtggcttgaaccaggtagtggcaaagctcgtaaagacaagtgcatgaataggaatattttggaggagatgctgcagtacttgcttatagattggattgtaggtgaccagtttgaaattcagctaaaccagcagctatggtccctcatccccaacaacgatgtgagaaggcttgtttctcatgttatccggaccttgaagacggactgcactgagacccatttgcaactggcctgtgccaagctcatctctaggacaggcctcctaatgaagcttctcagtgagcagcaagaattgagaactgtatcaatgacagcatggaagcccagaatgaacagaaagagcagaagtcgaatgagtccaatagatccgcggcatagtggcacccccaacagcaacagaattgggctgtcaacgtga

SEQ ID NO: 2176 - DNA, 1103 bp, Homo sapiens
cagggcgcggctacagcaactacttccttcgcaacccgttggtagggagaaggacgcctcagccactaggctgcttccggtgtgtcactgaacaccttccccgtaccagcagctggaggatttgtttggtagcacctgggggatggctctgtcccgggcgcacttaggcgggctgtgcggagcgctttaccttccacagtgtccggcacacgcatccttttcgacatcatcacttgacctgctgcaataggtgaccagtttgaaattcagctaaaccagcagctatggtccctcatccccaacaacgatgtgagaaggcttgtttctcatgttatccggaccttgaagacggactgcactgagacccatttgcaactggcctgtgccaagctcatctctaggacaggcctcctaatgaagcttctcagtgagcagcaagaattgagaactgtatcaatgacagcatggaagcccagaatgaacagaaagagcagaagtcgaatgagtccaatagatccgcggcatagtggcacccccaacagcaacagaattgggctgtcaacgtgaatggaacagacaaaagtgtaggactttgacatggactgagattcaaatctcaaccctgctactgactagctatgtgatcttgtctacgttgttttacctctcagactttcagtttcctgaggctccaaggaagatgatggtaatatttgcttctgaaactgcccctataaactttataaaattaggccgggcacggtggctcacacctgtaatcccaggactttgggaggctgaggcgggtggatcacctgaggtcaggagttcacgaccagcctgaccaatatagtgaaactctgtctctactaaaaatacaaaaattagcctggcgtggtggtgtgtgcctgtaggcccagctactcaggaggctgagacaggagaattccttgaacccgggaggtagaggttgcagtgagccaaaatcatgccactgcaccccagcctgggagacagagcaagactccatctcaaaaaatacataaaattaatcaggaaagaagggagggagggagaaacaaaaacaaaccaagctggcagca

SEQ ID NO: 2177 - DNA, 1106 bp, Homo sapiens
gggcttgcctcctcctgcgtcctgctagctatttttaaatgtgagctctattttgttccaagatcattaggatatttagccccttcaccaatttccacaagaaaattaattcattccaatattcagaggttccttttttatttcttagccagtgattaaggaatccattatgtaacccagagccattctctctactcttttcttaatttttccttctaaaatggggagttccattttcttaatttttcattctaaattggggagttccaaattttttttctctctctctcttaggcaaagcagttcatgtccttcctggaagttttagtatctgccagtactgatgcccagtttgcattttaaaagctccttctagctgctagatgctgaaaagactgaaaggaggcaaggggataggcaaagggaccagtatcaggttattttaggagatgatggtggcttgaaccaggtagtggcaaagctcgtaaagacaagtgcatgaataggaatattttggaggagatgctgcagtacttgcttatagattggattgtaggtgaccagtttgaaattcagctaaaccagcagctatggtccctcatccccaacaacgatgtgagaaggcttgtttctcatgttatccggaccttgaagacggactgcactgagacccatttgcaactggcctgtgccaagctcatctctaggacaggcctcctaatgaagcttctcagtgagcagcaagaattgagaactgtatcaatgacagcatggaagcccagaatgaacagaaagagcagaagtcgaatgagtattccttcaggtcctgatatggaagaaactactgatgtcagctgaaggaccacactgatgcagctgtcctgaaggactccccgaggagctacctcatcaaaaaatacagtttccactttgcgatgattttatcccccttgccccaaccgaccagcaaccccaattttccagcccctcactctccacaatcctcttaaagccccaggccagaacttcttgggagacagatttgagggtttccttccacttccttgctgggtggcctgtgatcattaaactctttctttgctgca

SEQ ID NO: 2178 - DNA, 1094 bp, Homo sapiens
gggcttgcctcctcctgcgtcctgctagctatttttaaatgtgagctctattttgttccaagatcattaggatatttagccccttcaccaatttccacaagaaaattaattcattccaatattcagaggttccttttttatttcttagccagtgattaaggaatccattatgtaacccagagccattctctctactcttttcttaatttttccttctaaaatggggagttccattttcttaatttttcattctaaattggggagttccaaattttttttctctctctctcttaggcaaagcagttcatgtccttcctggaagttttagtatctgccagtactgatgcccagtttgcattttaaaagctccttctagctgctagatgctgaaaagactgaaaggaggcaaggggataggcaaagggaccagtatcaggttattttaggagatgatggtggcttgaaccaggtagtggcaaagctcgtaaagacaagtgcatgaataggaatattttggaggagatgctgcagtacttgcttatagattggattgtaggtgaccagtttgaaattcagctaaaccagcagctatggtccctcatccccaacaacgatgtgagaaggcttgtttctcatgttatccggaccttgaagacggactgcactgagacccatttgcaactggcctgtgccaagctcatctctaggacaggcctcctaatgaagcttctcagtgagcagcaagaattgagaactgtatcaatgacagcatggaagcccagaatgaacagaaagagcagaagtcgaatgaggtcctgatatggaagaaactactgatgtcagctgaaggaccacactgatgcagctgtcctgaaggactccccgaggagctacctcatcaaaaaatacagtttccactttgcgatgattttatcccccttgccccaaccgaccagcaaccccaattttccagcccctcactctccacaatcctcttaaagccccaggccagaacttcttgggagacagatttgagggtttccttccacttccttgctgggtggcctgtgatcattaaactctttctttgctgc

SEQ ID NO: 2179 - DNA, 2820 bp, Homo sapiens
gtctgcggaagtggtgacccgtgggacgcggctgagacaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 2180 - DNA, 1033 bp, Homo sapiens
gcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgt

SEQ ID NO: 2181 - DNA, 2941 bp, Homo sapiens
atggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgt

SEQ ID NO: 2182 - DNA, 1584 bp, Homo sapiens
ctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttag

SEQ ID NO: 2183 - DNA, 942 bp, Homo sapiens
agcttttgatgggctgtgtaaagaacatttagattactattcagtaaaatggtttgtgttctttcgaggagtttgagcctgtaactttcatttggttcatggttctccctcagtccaagtcttttattctaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaaggtttccacatgttggcggatgcagtggaagcttctcttgagatctttgccacactgttcaacatgtttgaccactctgtcctaaaaacgctttcttcttaaagcactttctcctcctggcttctgtgtgtcttactctccttgagttccctctgcctctgtggccagtccttcctcacctctcttgctggcaggttaacagtctccacttcaatagcccaaggctcagaaagactgagtaatgcgtctaacctcctctagctgataa

SEQ ID NO: 2184 - DNA, 1605 bp, Homo sapiens
gttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggtaggtgtcatctttcagcagatggggattctgtaaaggctgtccctgcacttcacacaggaatccacgttctcagtatctctttcataacaaataattaaatctgttacagag

SEQ ID NO: 2185 - DNA, 867 bp, Homo sapiens
aaagggatggtcaagacccagcaagcaacaggacaacccgactctccgccccggcccgccctcaccggcaggcgggttccagcaactgctgatgcggatgagaaggcctttggcgggtggaggaaaatcttggggtatcgcacatttttataaaccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcag

SEQ ID NO: 2186 - DNA, 704 bp, Homo sapiens
agctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggtaagaaaataaaatgactggaagcttctagataaatctgtatctcaagtgagaaagagaatgactttttttgaatttgatcttcacgtcacttactgtatgcaaagctttcaagtatatttaaaacataaatttattatgttagctttcaataaatttctttttttaaattagacaaatataagaaaatctgtaaattggtaccttttcttttaagttccattagtggcttccccatttcccacctgtactgtatcccagctgagaataaaacttgtatcaaaa

SEQ ID NO: 2187 - DNA, 2288 bp, Homo sapiens
ctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 2188 - DNA, 1436 bp, Homo sapiens
atgcggatgagaaggcctttggcgggtggaggaaaatcttggggtatcgcacatttttataaagtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcggctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagca

SEQ ID NO: 2189 - DNA, 873 bp, Homo sapiens
tgcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtggggg

SEQ ID NO: 2190 - DNA, 514 bp, Homo sapiens
agatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttagaatttcagtatgttactttgcagaagtttggactgcctgtcttttgattttgtattaaaacttgatttgtcattgtaa

SEQ ID NO: 2191 - DNA, 710 bp, Homo sapiens
gggggtggggggcgcgggccgggcgtagagggggccgggggccggcatggagggttttcgggccgagccgctgcgaccccggccttgcaggctgggcgccgggcggccgcctctgcgcgccgcgatgggactcggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaa

SEQ ID NO: 2192 - DNA, 1362 bp, Homo sapiens
acggaccggcaggcggcgggcggtccgcgagggggcggcggcgtccgggctttgtggccgcggcgcgcgcggcggggcctggccggccgggggcgcgccgccgccgccgccgccgcccggcgttcgggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaag

SEQ ID NO: 2193 - DNA, 780 bp, Homo sapiens
ttgtggccgcggcgcgcgcggcggggcctggccggccgggggcgcgccgccgccgccgccgccgcccggcgttcgggagcccgcggccctcccggccgccctgcttgcgagaggagcccaggccgcccgccctcgcgcctcgccggcccctcccccggtcgccgcggctgccgcgccgccgctgcaggaatttcccagtccagtgtgggagatggacgcaaagagcaaattgcaaaaaatatgggaagtgctacagtacagtcatgtacaactgtcagtgagctcatagaagagtaactcattctgagccagtgggaactcagggccaatctatatctaacaaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccg

SEQ ID NO: 2194 - DNA, 4763 bp, Homo sapiens
gtttagtatttttgagaacccagccacctggccatgctgtaccagccttgtgctgagtgctggggataaaggaacaaataaaacccagtccaggcttctgtgtgcccagccctgtgccgggtcccagtgggtaacagcatgtccaatcccctcagtgtcccactagaggcttcctttggggctgctggggacatcttgtttctagttgagaattcagatttatgtccaaagacaagaactccctgaggggcagattacaacatggactgggccattacaatcaacaaggacacaaagctaacacagccatcgttatacaccagacatgtgctaaggacttgatttccccattgtttaatcatcaccaactccattatcacccccatttcacagatgtggaaactgaggctgagaagagtaagggacttgtccaagggcacagagcaagtcagggctacggtgatgtttcaggcccagacctgtttgcctctggagcccagggtttaacacaccccagtgctgctgtgaaagggctctggacagctcaggctggccggccaattcggggataaccgaacagaggtatggaacagaaaggggcgttgaggatgttgctgtgtgtgtgcggtggggggagtgacaaggcttcagcaatggtactcattctctccaaccagctcccagtgctgctgtcctctgatccaccctccgctctgcctgccatggactaattgttctgaaatcccatggatcaagtcactcctcagctgaggacctgtccatggctccctggtacccagaggatagaaacccagcattcaaaacctctctaaccagctccccacctcaaccctcacactcctgctcactagcccccaggcgcagtgggctcttccagcggccaagcctgtgcctacggtgccttcttgcctggaatgcccaactcccccttctcagccttctttgactctcaagtaaggaaaagcactctttgtctccctgagccccttggcacttatcacagagcactctgggcgttaacttccactgtctccgtcttggattagagtggatctcagagggcccggtggtgtctgcttcacctccctctccactgcagcagcttagcaaggactggccgggtaaactaaaaaatgcaaagagctgagagaatcctgggaaagtgcacatttcccaggactgcccaatgacaagccccgtaccaaggcacagcatcaggataccctgatgtggaagaaccaaaaattgcaccctcatggcttatcaggatggtccttgtgtctgtccctttcaagggttctgataatgaaatctgggcaagtcaccctcctgctttaaaacttccaatggttcccagaggtctagcataaaatccaaactcaagggcccacataacctaggtgctgcctggcccccaggccctcctcttgccacgcccccctccctggccagcctccctcacttctttcagttcctcaaggactccccctcactaaagccttacccaggtcgcctctctgcctagggggctcctccattccctgctcactcagccacctccctctccctcttcaggtctcactttttaggggaggcttccctgatctgtccagataagacctcaccactcccacccaatcccaaacgctcccataacctgatcgtttccttcacagcaagaattaatcttcagtgtaaataatgatctactgaagacctatgaggaatgggaaagtcttgttttttgctgattcttcaacacccagctcagagcctaaatatctctcaaatgaatgaatatatgaatgaatgaatgaatgaatgaatgaatgaatgaacctatatacataaatcaagacaagaaggtgggcagaatcctagggaacactgaggcaggaaaagcagggccctgggccaggcgtcatggctcacacctgtaatcccagcactttgggaggccaaggcaggcagatcacttgaggtcaggactttgagaccagcctggccaacatggtaaaaccctgtctctactaaaaacacaaacattagccgggtatggtggcacatgcctgtagtcccagctactcaagaggctgaggcaggagaatcacttgtacctgggaggaggaggttgcagtgagctgagatcgtgccactgcactccagcctgggcaccacagcaagactccgtctaaaaaaaaaaaaaaagaaaaagaaagaaagaaagaaaaagaaaaccagggccctaactaaaaaagacaggaggaaaaacagggccctaactaaaaagagaggaggggccctaactgaaaaaaccagggccctaactaaaaaagtcaggaggaaaaacagggccctaactaaaaagagaagaggaaataaaccagacagtgcagcctcccagaagcaaaaggagggagtttctggaactgcactagagactggcacatggagtcctgaggaaagagcactggattggacatcgaggaggtcactggggcctccctgattgaaccaaggttccgtggaggtgggcacagggctggtacattgcagggggcagaggagtaaagagggatgaataagcaaagctctcaggcgacggttgctcagctgggtctatgccagcctggccctgcagggtctgcggaagacagggcccctgtgtcatagtcaccaaaagcatcaacagagcataacattctttttgttgacagattacattgaggcaacttggcttttggagttatcagggctcagtctcaaaggcagatgcatcagagccaagacccggccctcaagtcctcctattagggcagcactagggctacctctttgtcagcagaacctttggatagccgctgatggggtgagtcagctttctgggcccggcagaccttttgggaatccctggcttttggggcacaacatcctggggaccaccaaaaagccctttcacctgagctttgggaaagaggaacagctccggctgtgggtggctcatgtcaccatctggaagccagctgggccacagcagacgcgtaagtcctgtattcattcatccccttctccttttggcagaaaagggatggcgtgggttggaggggtgttttcctgggttcttgcacaattgctcattagaaattcacttctgtttgggtgttggaagctgggcgattccccctagtagtgatccttcctgtctcactggtcacaaagccctttggcatctacaagctcgttgggtccacacagcagctttgttaggtgggtagggggagaccaaggcacccatcctacaggtggagaaaccgaggctgaagctgggaggtgagccagtctcctggcttccagcccaggactctgcactcctccccccacctccccacctacttcagcaggtcacctgtgaatctgatagtcaggtgggccccaccctgccagctggccccagcgggcatgactcatccgcttccccatgactcacacacctcaggtgctcctcctctggtcaacaagtccagagacttggcaaatggacccccatttttctcacctctccaaagcctctgggaagaattcctgcacctcctctttatggggactctgctcttctacagaatagcaaccaaggccttgagagggaaagcaactctcctaaagtcacatagcaagcaaccagcacagccagggtgggagccaggcatccgggcaccgagcccagtcccggcctcctccctacaagatcactctcgcctgacctccctctcaaggacaggaaaggagcagagacgcactctgagccttattaggaagacctcagggactcccactgaatccactgtggctacagcggctgcttccaccactgaagtcccctccaggcttccctgggcagccagggcggggtttaagaggacgacaggtgtctgtattgctctacctacctaacaaggctgtgcagggtgaagagtgctgctccgtgggaaggcgctgggaccaaggccgaagcactggacaaagagagctatgagcactacctgtaaacaaagggcacagaatgtcagcctcagggggagttcaaggtcatctggtcaaatccccatttgatgtttcaacccctttcctcccctccaccaggggtcacacaatcagtacttgcacacatccagcaacaccgcactcactacctgccaaggctgcaagacctgctgctggagggtttggctgcgtaaaagaattgtcctaaggatgcactaaaatctctctcttcttatgccttgtacctgctggtattagctctgcctccttttgggtcagccagaacaggtctgtccccctctttcctgatggctctttggagatttgaagacagtgatcctgggcccctcaagtcttctacaaattgtgcaccccctttcctccagctcttcctgagaccagggtttccggttcgctcaccctgttccctgatctgctccagatgaaacctgtccctactgacagcacaagacccagaattagacaatcagtcaagctctatccaggacagggcaagcaggactctcacctccttcattagagatatcatgcttctattaattgagcctaaaatcccatttgcatttaaggcagccctattgcatggctgaattcagtttacagtcaacttcagagctgtacgttagtactctgaagttatataaactgggccctcacttaactgtgtaacttgagcaagc

SEQ ID NO: 2195 - DNA, 4728 bp, Homo sapiens
caagctttgagctttgagctcagaagacgtgggctagaattccactctagcacttgttagctttgtggccctggataagtggtttgcaattttcttttccctttcctcttccaaatgaccttctttcaaatatttgagccctatccttccagtcttctcctagcctccctgtgtgataagaccttcatttcctttatcactttggtcacatgcccagctctgcccatgcacatgcaatactcaaagatgcacaggattccccaggtgtggttctgggtcagggagtcatcagggctggcaagggctgggagaatggaccagaaagccatagagtgagatacagggggaagaagaacacagactggcacaccagatccccggccctcaccttcacggtcctttggccaagctgccccctggttccaatagttctgggactaaaccctggcttttgcccttgcgccaggagtagtggtgaatgtaatcattctggccacatcattgagggaactagatgggatcagggccagctttgcctcctgttcactttgtccagagctgacatcagagcctgctggagagtaggtgagcagcaatatgtgtccctttttacccatgtccagatgcagcatccatccttatgacctcattccctccccagctgagattcattctcagtcacacacagtcttttcagtctagaagcaaagactcttctactcattgtgtaggtcagaaagagaaatgcaaaggttttgagatctgatttctgacctgaagatccttattactagctatgtgtcttcagaaagtttaacctctcttagtttcagttccttcatctgtaaaaattgagacataagtagcccatacctcatagattgcaggaagaattaaatgatgtggtgtatacaaactcttagtctaagtgattgatgtgtgttggcttcttgggggaaggagaggtgacagtgaatgatttcttaccccactacctgtgagagcagagcaagacaggctgggcttgcccatcaccctgcccttcaaccccctgtgggggacctagggttcaaatgaacgtcactatccacacttctgtaaagttggccagtgttactctggggcaaacctaaatagaatgtcaaacggaatttgaattttacagaggaaatgtgaaagtcttagagaacatttcgctagtttttaaaactttttataggtcacagttcagttgccttgcagtttcatgaactttgccagtgttttcaatttagcataaaaagtgtggtcagatttgtataaacctcacctgggaacttgtttgaagcacaagttctcagacccctccccagactcactgaaactctgggggtgcagctcagcagtctgtgttcagtgagcactccaggtgcttctcagggctcccgtttgagaacactggtctaggtgttagaagggtggtcccctcccttctccccttcctcccacccctggcagttttgaggtccagatgaccaagcccggctctctagccgtgtattttcagcacttccgtagtgtgaagacagctcctgagagaatgactcatcgtctcatcctgggagattcatgtatttgtgtcacagcaggtgtaatctaaatccaagcctaggcctggaaaagagttaggaaacaaacatctgttttgggtgttcagactgacagatcagttgtctccctccacctcggaggcttccttcctgatctcctgaccacagtaatagttctctgatggctaatgaaaatagcaaattttatcaagttctaccttttggaaaataccattcattattttccctttaatcctcacaacagcccaacaaggtagatgctattaagatccttatgtccttcacagtgaaacagcctcagagaggctaagtcatttgcccaagatcgtgtagctaataaatgggagacgagagacttgagttcaagtcagacaccagattctgtaaatcttcagccagacttcccacttggttaagcaagctagatccttgagccaggaatattctaggcctgtggttcttaaaatttgtcatggatcaagatttctggaggacatcttaaagcacagattgctggacccttgtccccaagtgttagattcagtgctgctaggttgaggcctgggaatttgcatttctagcaagctcccagatattgctggtgctgctggtccggagaccacacttaaagaatcacttctgtaggccagtatttctcaaccagggctgtacattagaatcatctgaggaacttcagattcaattgttctagtgtgagacactgccattctatttttttatgttccctggataattctaatgcacagccagggttgagaaccactgctatactcaaaggaagactactaattcctttttatagctttggttcttgagtcctgtgtccatttttttctaacggcagcatgcatacttctgggaaactcagtgtgtgcaacgggtaccaacactgcaagacaaatagtgctcattcatttcatttcaatattttctatgaaacaaacatctattgtggagtataatgcaaagtgttcatgaactcttaatgtaaaatgtaatgtaaatgggatttagtccactcctaagaatttagccaaggaaaattgtcaggaccaactgtcaaagatatgtacaagaagaggcatctaagtattactttgtcttgataattgctgagtctgtgtgatggttatatggtgattcattgttcaaagaatatctaatacttatgtcaagtacaaaaaggaggatacaaactgaatatttagtatgactctaattgtacttttaacaaaactatatacatacacacacagaaaaaagactggaagataacacaacaaaatattaccagtgattatttcttgatgggattatgggtgataatgataacattttctaatttttaaacaatattacttttatgattagaccaaaagaatttgtgtaggcagtcacctattcttgtaaatacattctacaatgtctgcctgaaatacaaagcatgcatttgtagattagaagttttttcagagaattagaaagcatcttacaattgttaattaaggtcccaatgggtgctaatgcctttgggacctggaaatgtgagaatcatcataggaacctagggagattgtgctgggcaaaagggcttttgctctgcaaggtggttcttctaatggggttaggcagcaggggttgctagaggctcctcaggatgcatggggtgagtgtggggcttttgtcctctcctctagcgagtacacactcctccacagtgcttctgtgtgacatcaccaaagcatccactataattaatgtatcatagatcaaatgcaccctagtaaagggaatttagcaatgtccatgtagtgtgcaaatatgcaggaggtaagaaagttaagcatatgtaactcaaggaccacctatgaatgttaataaagaaagaacatatggagaaaactcttgtattgcaaaacatgaagcccatgtgccttcatcatccccagaagtctgtctgttcatgctccctgggattccgttcagaaaacaagtaaatggtgccttctgcacatttatgttaaacggagaaccaaaaagagtgactaccccactccagtgcttgctggggctgggagaacaaagaagctgcaagtatgaggtactcaaagacagtgttactagggtaatgattttccagtatggccaaaagacatcttctatgcaaccaagcctcacctggccttacaaaacaaaagtggtttggccagagcttgaataacagctgggatggatggcccaatgtaaaggagcaggtggcaggccagtggaccccactctggggtggccccatggtggacagagcccctgctccctaaaatggccaacacctgtcccaaggaaggccacctagccagaagtgcccaccatctgctgtaatcaaatttgcaatcacaggtaacttttcctctcaagggtccagctggcaatataaataaatggaatgaatggggctcctcagatgagtacagcatcttccatgtatggggagcagacattactgagctgctgccatgtgggaatctcagtccagttgtgccaggtcttctgagttattccaagagaagcaagaattcgtctttgtgttatagtttccagtttctaaatattggtagcattttaaaaatatgtagtccaaagaagacagtcctgtgggctgactttggcctgcaggcaccagtttctcatctctgcttgtgaatgtcaagttctagagagaccattgctttagtcacctctgtcctctccctcctcttcccactcctgcctcaccaagaccaaattccaaaagaccagttctcctcaaaagttgtgtttcataaggaccttaaaattggctactagtctaacagtaatttatttcagttgaggactttttaaactccatgactaaccattgagggtactttctggatgattaagttaataattttaaaggaattgccttggtttttgaggggtagagggtatattatttgggaagtggctgtttcaaagtgagtgggatctaggtttaaatccagcttcaccacctgtatcacttaagcaagtgatgcagcctctcttagtttctcattatttaaaaaaaaaaaaaaaa

SEQ ID NO: 2196 - DNA, 1409 bp, Homo sapiens
gcgcccgcggggtaggagacctggagctggagaacccgcccgccagagtcgtagtagtggatggggagtagccgtcccattttcaacacatgtctcattctaaattgacgttttggtgggctggccgaagaaggagaaagacccgcggctccgacctctgacctctaaccccggacgcactttgatttcgccggcttgcgcggaaggctgactccctgggccgcggcctggcgcgggagccgcctgtggggtgtccccggcgcgggagggtgctctggttcaggcccgctgcccaggtatgcacaagtcaaggccttttctgcagaccaagtagccttccctggagagcgcccccagcaccacggaaactacctacatgccccgcggtggtcagcccgccttatcccagccccgagacccaaaacaagaagcatggactgaatttgaggtttctggatggtcgtgtgaaccgaggggacgggtactggactgacaagaaatgagccttgaaggtcaatctgggtgacacccgagtctcctgatggagtttcactatgttgcccaggctgatctggaactcctgacctcaagcaatccacctgcctcagcctcccaaagtactgggattacaggagggagccaccgtgcccggcctggtcctgtgcattttatagataaggtaactgacaaacctagccacagtcaccccttcgccctaaaggagaactggaatttgaacccagagccttcttcaccaccatctccgttgtttctggaagcaccctccaggcaggccagccagcatcacggggcctcccctggggctggaacgtctgcaggatgcccctttgagaaatgctgttccacagaaccctgcctttcaggccttggagacgtgggcaggggagaagcagcgtccctcagagccaggcctggcagtggtgctagcaggggccaaggcccagggagcagggtctcctgtcggagggacctgggcaagcccctccacgcgccagcgggtttctcagcaggggaggtccacaccacaccgcttgggaacctgggtgcctaaacgcaacaggagccaaggcacaaatttaaccaaacaccaaggttgcgtgaggccccatttcatgagccgggctccaaggacgtgtccttaggcggctctggaaggcccagcgccagcccccgtcctctgttaaagggagccagccccgcggctccgcccaggcatggtagcctgagcgcgcccccagggtagtagggggcacctgaggagcagggtctgccctggcatgagcagagcccaggatggggtcagggtcaggccctgccagaggctggagggtgcccaaggcgaggccggtgaggcccagctctacaaataaagtgttttatttacagga

SEQ ID NO: 2197 - DNA, 2758 bp, Homo sapiens
tttttttttttttttttgagatggagtcttgctctgtcacctaggcacgatctcagctcactgcaacctccacctcccaggatcaagcagttctcctgcttcagtctcacaaatagctggggttacaggtgtgcactaccacgtatggctaaattttttccttttagtagagacatggttttgccatgttggccaggctggtcttgaattcctgacctcaagtgatctgcccgccttggccttccaaaatgctgcgattatataggcgtgagccaccacgcccagctgggaatgtttttaaattagtattttcacatgccattccactgtctcctagcttaaattgcttctaatgaaaacttggtcatcttcactgtgttatctttagtttttagcattcttgtttgtgatataccactgtgcattttctttatatttatcctgcttagaatttacagaacttctttgacctgaacttgtatctttaatcagttttggaaattttgggctactatattttcaaatactgttttcactctactctcttctttaggaattccaaatataaatatatatatacacatatatacatatatatacacacatatatacgtgtgtatatatacgtgtatatatatacacgtatatatgcacatatatgtgtgtatatgtatgtatatacgtgtatatatatacatacacacacacacacacacacctttcatcaagtcctatgtgtctaacactcttgtacatgtttcagtatgggtagtttttattgacttatcttctggtttcctaatcctatcttctgctgtgtcttatttgttatttttttatgttttttaattttttttttgagacagagtctcgctctgtcgccaggctgaagtgcagtggcgcaatcttggctcactgcaacctctgtctcccaggttcaggtgattctcctgcctcagcctcccgagtagctgggactacaggcacctgccaccacgcccagctaatttttgtattttcagtagagacggggtttcactatgttggccaggatagtcttgatctcctgacctcatgatccacctgcctcggcctcccaaagtgctgggattataggcgtgtgccatggtgcctggcccttatttgttattaaatcaatttaacaaggtcttaggaaactataattctcagttctagaatctccatataattattttgtgaattccaattctcagctgaaattcaccatgttttcagcatattaatcacagttacttgaaagtttctctgataacttgaattatcaagatcacctatgggtctattcccataattggtattccttctgttttctgattatgtggcaccgtcttttggcagaatggcatttttgcctccgtcatggagccaaaagcttcagatattatcttatataaaggaaagttcaaccttcctactgctggagagataatgtggtggtttaacatttaatcagcatctatgctgagtcaaggctggtttacagtctttaagtaagatttagtctacctgtatgccttagccatccacttttcaaactaaaagacctacatattctgtggagccattacaccagttaccctaaaatccagtgtatgccttctaagactgctgaaaatgccactttttactacatttccagcctcttgtccagcagaagtccagtattcaaccaaagcccaaaggtgaaagcaggccatatgcttgaggcatcccaaatatctgccaaaaactctgctgactttttccatcctactcctagctgctctgaactagattttacactgcatccagaattagcagattccctaggggcaaaacacaactacaaagctacctgccttatgagattcttacctctccagagacatacccgcagttggttctctttgattctctggtgcattcaaagagatgactatttgatcgggctatttagttgttttagctaaaagcactaatctactgccagctgtcccaccctacctgcaaacaggtgctttccatgtactactttaagtgattcaataaatgtcacaaattcaaggccaaagccactttttcacttatgtaccatttttgttaaaggcttatcaagacactctttatgcacaaaactaaatgccattgatcataataaaaacatgcatataatcaattcattccccaagaaatatcctatttcactgaatctaataggccgatacttgtaaaaacaatttatgtactaataaaaaagaaactagactgaaatcaggcagtctaagaattcccaaataaagctgggacactaaatggtaatcagcaactataagacacattatgtaatttcaagtaagaaaaaaagactgtgatgaggtgtctaaggaacaccttcaaataaagcttagacaccaacccattctcacagttaaaatgagaaataaaccacaccttgcagatagaaaaaattcttgtttcaatactgccactgggtataaggaaaaaaaagcatcctccaagaattaaatgataagctaggattcagtccggttcagaggcctgaattcatgctacctatgtggtctaaaaaggctcaagcagagtatttaagttaaagttaaatggcactcccaagtgactagtaaacaagcaaattcaaatctttgaaagaattcaacttctgtcagcccaacagcaaatttaagatacatttttatttcagagatgttaaaatacc

SEQ ID NO: 2198 - DNA, 1012 bp, Homo sapiens
ggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgtatgtgaaagtttgttctatttctgtttattttagggtcaacctctgtattttgaggtcttttattttctggatttcatttttataatctggcacaggctatttgctctactcagaaagttttaacttaaatgttcagtcatttgattaggcttaatagccagagactggatctgttcacttgttttccttttttaagtactaatataactgttgagattttgatgcattttgacataatgttctgttttggaatacagggttagtgacttaaatttttaaaagcaactttactagctagaaattaatttcccttgcttaactcatattttttcagtgtcttgtatctattgctgttcatcttttattgtaagaaattgttttcacttataaatctcaaggga

SEQ ID NO: 2199 - DNA, 4130 bp, Homo sapiens
gcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatgaaa

SEQ ID NO: 2200 - DNA, 1010 bp, Homo sapiens
gcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattc

SEQ ID NO: 2201 - DNA, 715 bp, Homo sapiens
gttctgaggctgcagttggaatcagacagacatgacctcctacgcagcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagattt

SEQ ID NO: 2202 - DNA, 2130 bp, Homo sapiens
cctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatggtactaagactgagtgttatttagattttattgttgttgtttgtgtttaacgcgaactatttaggcagcccagggataatgctggccatatagagatgcgcctgattaggtctcaggagtcaattcggactgggcagagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtattgtggatcccagaagaaacagagatacatgtgagccagcatgggaagaagaaaagaaagaactcggcagtgaaaagcaagtcatttctgggtctctctggaaatcagtccgcaggaacacgagtaggaacaccagggatgatcgtgcctcccccaaccccagtgcaattgtctgaacaattcagttcagatttcctacctctctgggctcaatccgaagcgttacctcaggatctactgaaggaacttttgccaggtggaaagcaaaccatgctctgtccagagatgaagataaaattggccatgatgaaaaagaatcttcccttggaaaagaaccgacctgacagtgtgatttcttctaagatgtttctatctatacaccgcctcaccctggaaagaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaatccccagcctttttaaatttagattatttcctttccattagggtcagaataattttggtgattaaacacaactgcttttcaa

SEQ ID NO: 2203 - DNA, 2049 bp, Homo sapiens
gcggccgggcgcagcgcgtgggagacgaaggcgtggctgactcggcggggcggatccctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatgagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtattgtggatcccagaagaaacagagatacatgtgagccagcatgggaagaagaaaagaaagaactcggcagtgaaaagcaagtcatttctgggtctctctggaaatcagtccgcaggaacacgagtaggaacaccagggatgatcgtgcctcccccaaccccagtgcaattgtctgaacaattcagttcagatttcctacctctctgggctcaatccgaagcgttacctcaggatctactgaaggaacttttgccaggtggaaagcaaaccatgctctgtccagagatgaagataaaattggccatgatgaaaaagaatcttcccttggaaaagaaccgacctgacagtgtgatttcttctaagatgtttctatctatacaccgcctcaccctggaaagaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaatccccagcctttttaaatttagattatttcctttccattagggtcagaataattttggtgattaaacacaactgcttttcaa

SEQ ID NO: 2204 - DNA, 2759 bp, Homo sapiens
cgcccctcgggggcggctgtggcggaggaacgatggccgacggcggcggccctaaggacgcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagctctggcactggctaaataagaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctagatctgaaatcttcagtgttgatgtggtttcctctgcagtgatttttaggaagttcaaatttgacagcgagttcagctcagctgtggccctctgcccttccagctgtgcctag

SEQ ID NO: 2205 - DNA, 7980 bp, Homo sapiens
cgcccctcgggggcggctgtggcggaggaacgatggccgacggcggcggccctaaggacgcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagctctggcactggctaaataagaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 2206 - DNA, 7971 bp, Homo sapiens
cgcccctcgggggcggctgtggcggaggaacgatggccgacggcggcggccctaaggacgcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaatcatgtggtaaactt

SEQ ID NO: 2207 - DNA, 1620 bp, Homo sapiens
atttttcaggtgaggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgccttcctaggagagctcctccccagcaggttccgtgagttcctgcaccagctccaggagaagtgcgccgaggagccggagccactgacatccccagcaccgcaacatcaaaggggtgtattagagcactgcccagggtctccgcggtgtcccaactgttcattcctcccagacctgtggggccagtcatcgcacctccaggatagtcttacgaagatttcgctccagcagacacctattctggggcccctgaagggtgatcactcacaattcaccactgtcagaaaggccaaccacaggccccacggtgcacaggtccccaggctcaaggctgcgctgacccacaacccctcgggggaaggctctaggccctgcaggcagcgttgccctttccgggtgcgattcgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgctcagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggcacatcccaggtggctgggacctgccagtaggtgtcacaccacaa

SEQ ID NO: 2208 - DNA, 2138 bp, Homo sapiens
caggcggcggctcgcggaggcgcttctctgagcatgacgcgcggactccgctcccgcagcccgcccgcccgccggtctagcagccgcctccctcgcttcttgcgcccgccaagcgaaggccagtggccgcagcgacgcggcgcggagaggtggtgggtgctctatatggcggcggatctgtcgggcctggctgtccggctctagggctcggccgccgcccgcccccgtggggtcttctgcaaggggctgactcgcaagctgctgtcttcttcgatctggcctggcggctgcgcatcaacttcccctacctctacatggtggcttccatgatgctcaacgtccgcctgcaggttcatattgagatccactgaaggccctcccggactgacgaaggcgtgacctcaggcccaccgcatccaaaaacacgaagcatgagggacagaagagggccccttggcacctgcctggctcaagtacagtgggccggaggaggtgactcggacaaactatcatacagccttaagaaaagaatgccgacggagggcccttggcctgcagatgcaccctcctggatgaataagcctgcggttgatggaaattcacagagtgaggcattatcactggaaatggctggcctctcgcttcccagtggcggcccagttcttccatatgtgaaagaatcagcaagaagaaatccagcctcagcagctactccgagcgcagccgtgggtttgttccctgctccaacagagtattttgctcgggtgtcctgcagtggtgttgaagctctggggcgggactggctgggaggagggcccagggccacccacggccacagaggacagtgccccaaaggagagcctcgggtgtcacgactgacacgccatcaaaaactgccggaaatgggaagtttttgggatgacccaccaagtgcttttcccagtggtctgggctctgagttggaaccctcttgcctgcattccatcctgtctgcaacactgcacgcgtgccccgaagtgctcctgaaagatgagacgaaacgcattttccttgaccttttaaaccccatgttttcaaagcaaacaatagaattcaagaaaatgtttaaaagcacctcagatggtctgcagataacactggggttactggcgctgcaacattttgaattagcaaattcattatgccatagtttaaagtacaagcagaacaatgcaagtagattaattttaagagttgtcttagaatgatttctttcgcattaagtctggatgcaaactatgcagcccttaggttcctggtgtggtttgtacgacctggcagacttagttgagtttgaattcaaagccggttgatgcggaaggaaattttttagcatgtgttaaattgtgctttaaaagacatataaaaaattgggaaacatttcaggagacgatcatagcctgtataaatatcagattagaacatacggatttaccatgaagttctgtcttcaacacccaacactgtctaaagggctactgtcccaaatcctgtgtgtcccttcggcttgtctgatcacccaatggaagtggatacttgtgaagtctacactgctgtacttggcgttaaatcttgctgaattcatggtaagctattatcatttctacattttgtagaatgattttggtctgcagcaaaattctatttcacttctcacacctctttccttccacttgaaatgcaatttagacagaggcattgtggtgaaagttgcaatattaaacttacctttagaagatcccttctcaaactcggaaccctagcagtgttaccttaaaaatgagctagagaaaaaaatagctcagttacagagaagcaaatcaagttatttcccacataaaaagtttcccagattctaggaattgcagtatcttgtaccctaaagtttttccaggtgactcctttggttgtctgttgataactttgataaaggtcatttaagggcataaggttttaaagactcccaaagtgagacttaaccattttcgggattagtgattgcatataccagtttatgttgtgtgctgaattactatgccatgtgctattttagtgtttggggaaaatgaaaaataaaatttgttctttagcgtaataaa

SEQ ID NO: 2209 - DNA, 602 bp, Homo sapiens
gttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaat

SEQ ID NO: 2210 - DNA, 1924 bp, Homo sapiens
ctccagccagggctgagtggcagtgtgggcaccgcggcccgggacgacagcctgggctcagagtcaggcttgtggcttcgcctctcagcttgcgtctcctcccctgtgggatgggggattccgtggcacccccatgatgaacaggatgccatgggcctcagcccagggcagacctcagtgtccttcctgtggccgctgctggaggtgcgtgaccacaacacagggaggggactcgtccccgccactgtgctgacgcctgggtctccagagaccctcctggaactccgccaggccttcctgggttccagacaggcccgccacgggcatgacgcagcgccatctagcggacagcagggctgcagcgtggacagaacggccggacgcccagtcctgggctggcggctgaggaacagcctcacagggcaagagggcaggcaacacctgcatctttccggcataagaacctcaagaaaagcaaaggaatataagcctgtgttctttggagccaccgaaatctctgttctcatggcagtcgctgaaagtttaagggagccgccaccgccccaatggggttggtttctttcttccctgtttttaaagatcttttaaaatgtctagagagaccctgggatccagtgctggacggatgatgcagggccacacagagaggctattgtgtgtcacttgctgggttaggaacagacggatcagggcttctatgctgcgtctgcctggtcctgggagagagaaactcacacaaccatctgcctggaagacctgggcttctcaggctagagggtctgcacatgtaggtgtgtgtgcatgcatacatatgcctgcgtgtggatgtctgtgcttcacacaaacaagtgtacttgtgggcatatgtgtgtgtgtgcctgcatgtgcagctctgggtatgtgtgtgtgcgcatgcccctgagtctctctgcatgtgatgcatttgtgcatgtgtgtgcctgtgtgcccgggtctgtgtctatatatatgcatgcatggatatgcatacgtatgtgcatttctgcacatgtgtgcgtatgcctgtatgtgcctggctatgtgcacacacatgtgaatgtctgagcagctccagagggagggccaccaccctgcatggtggacattagtttgagcctgtgaggaccagtgtcccccaaagcccctcaactacagcccagcccaacccaacccggagcagatcacaggccccagagacatctccaaccctcacacatggttcccaaacccgggctatccttcactctgcaggggcgggccagccctgcccactgccagggacccgctccaaggcgcctgcaggagggctgtgggcgacagtgtgggcgcccaccagcaggagggcctgtcatggtctgtgcacgaagctggtgcgctgtcttctccaggaactcgcaccttcgctccccctcccctgccagccaacactttcaggtttctgccataaaagagaaaaaaatctccctccctctctacccgctccgcgcctgctccttctccactttttgcagatcaaacagcatgcatggagtcgagcctgctggctctgttccgagctgcactttgggcatccgtgggctgccttgctccttgtggggtggcttcaagagcaggtcccaggtgtgcctgcagcagtgccgacacccctgagaacacagcgcaccccagctttcggcgccaaccacacagccagcaactgggcttggaagcttccctgaggtcgacgctgcctggaaatggactttgctgcctgcattcaggccaggggccatgtttgctcccccattacaagttggcctcatattaacatgtctgaggactaaggctggtattctagaacacgcctttcactgattgtgttaaataaaagagaaagatgaaaaaa

SEQ ID NO: 2211 - DNA, 2067 bp, Homo sapiens
aaaggagaggggtgggagcggggtgggggcatcgcgacccagggcaaggcggcgagtcgccgtcttcgagtcccacctgtccgaagcggggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcaaaaaaaaaaaattcctgacatcgctatgtattcccaactttatcatttgtctgcctgtttagttttgacttatgttttttttttttcccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttctt

SEQ ID NO: 2212 - DNA, 621 bp, Homo sapiens
gggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgagtgtacttgaacaaatgatgatcattttgttggaccctcacaggctgcacccggattttgtttttgtaaaattcttttggaatcttttgaacctgggagggggaggttgcagtgagccgagattacgccaccgcactccagcctgggtgacagagctggactccatctcaaaaaaataaaagaaaaaataaaagaaa

SEQ ID NO: 2213 - DNA, 2443 bp, Homo sapiens
cgagctgccccggggtctctctggtttcctaatcagggcaacgccgcgggagagaacctttaccttggctgcactaagttctcggtgccactccctggcagggcgggaccttgtttaggccctgtgatcgcgcggttcgtagtagcgcaaggcgcagagtggaccttgacccgcctagggcgggaagagtttggcccgccgggtcccaaagggcagaatggacgggctcctaaatcccagggaatcctctaaattcattgcagaaaacagtcgggatgtgtttattgacagcggaggcgtacggagggtggcagagctgctgctggccaaggcggcggggccagagctgcgcgtggaggggtggaaagcccttcatgagctgaaccccagggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcaaaaaaaaaaaattcctgacatcgctatgtattcccaactttatcatttgtctgcctgtttagttttgacttatgttttttttttttcccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttcttaaa

SEQ ID NO: 2214 - DNA, 2786 bp, Homo sapiens
attatcttttaactagacagtctagctttctcagggcaagacaaaaatgtcccaattacttgtcagcagtttttagtggaggaaaaactgcagttaaagcacctttactgagaactttgagcagtaaatgtgcttacatatttagtttgtgcaactttgattaggaattggatggtgagttgggatcccccagtccttagctttttgctggagttctgtaaatctcaaaatgtcagccacaggccatttcttttggtttatttaagtgtagattttttaaaaaatcactttttccacttcatggctcctttggaccagggtataaaaatagcgatgccaccaggagccaagctctttctggaataatgaagcaggcgaggacggagccttgctcaggacgacagaaggcttgcagcctgcctcaaacgcaactctaatttcagccacttcacttcttccccccgcgctcagacttgcctcaaaggaaggagccgtttatgagacactccgtggcgcgcccaacacggttacccaggcgcctatcacccttctgggacccggccacctgtaagaacctggagggcggagcgggcgaggttgttcggggaagggatccccggcggctgaggacatccaggagcaccgagattcttggggaggacctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcaacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctcccgatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaataaacattatgagttctcaaaaaatgttttcgtcacaacctggcgtgaatgcttttctccggagaaacactgaaggcggcgttcttgcgattcaagggtacgctgcgtccaggtttatttcagtttcagactgaggtctgctaagaagcccggcctcaaactcaagataaaaacagaaaagtcccagtgttgacgggagtggaggagcccgtgttcgcttcaaggtgccggcgtgctgctctaacctgtgctatatatactcgagcactctccatataatgcctccatttaccaacttgctcttaaaaaataccaaagcaggccgggcgcggtggctcacgcctgtgatcccagcactttgggaggccgaggcgggcgcatcacgaggtcaggagatcgagaccatcctggccaacgtggtgaaaccccgtctctactaaaatacaaaaaattagccgggcgtggtggcgcacgccttagtcccagctacttgggaggctgaggcaggggaatcacttgaacccgggaggcggagcttgcagtgaaccgagatctgccactgcactccagcctggcgacagagcaagtctccgtctaaaagaaaaaaaaaaaaacaaccaaagcgaagtatttttggttcaaacctgcactatttaatatgatagccactagccacatgtggctattgaccactcggcattatggttagtctgaattgcccactgctggatgtgtaaaatgtacactggaatttaaagacagcgcagaaaacatcgtgtaaaatgtcttgttaatgattttcatgttgattgcatgttaaatgatactttggatataaaaaatatattattaaagttaatttcacctgtttgttttccccttttaaaaatgtggtttgcatttttaaaaatgtaaaattacacatgtggctcacatttgtgagcctcattatattcctattggacagtgccagtccaatacaacctaatttgtcacctaatactaaaatccacctaaggactatattcagtctcttcctgatacagccttccttcctggtttcagctgtgtcaggtagtttagtaacttttcagtactggttaggtaactccccgccccccaatgcccaccaaatatcagtgcccttttaagcatataagacaaagttcactgcatagactacaatagactacatacgaaaacaaacccaaagaaaaataaagcttttttgaaattta

SEQ ID NO: 2215 - DNA, 1854 bp, Homo sapiens
actccagcttcgagtgtgagagacccgtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgttgattccaaatcttggctattgtgaatagtgctgcagtaaacatggggccacctttcttttgctgaggctgatgctcggattgtattcatggtccgtctttgggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaac

SEQ ID NO: 2216 - DNA, 3910 bp, Homo sapiens
aattggggatagcaggagctgatggaaagaagatcgggattgttagcatttctctatccgtctagcacgccagacagggccagtctctccggctgggggcactgcgtgggcaacagcgaccgtgagggcgcgcgtctgcgctggggcctcgcgcgcgttccacgatgaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaacattttcttgtcaagctggaaaatttgtgtttttgcatgtttgttttgaacatgaaagagaaagcgctgtagttgggtggcaggtgcttatctgaacacttcccctctctctctctctggctctctctggctctctctgtctctctctctcaaattaattatatatgagctagaggaagttgctattcacaggaataacctgataaatcctccaggaaagactatcaacctgactttctcttttcggtagatccgtttttgttgttgtttgtttatttcttagtgttaggcttgatttacgtgaagtccactaaaaaccttggaaaagagagcattacgtctgggtagttcagatcttgttttagatgttgaatgtctgtgataaatttgtaagaggaggctggctcctctggagcgtagtttaaactgctccttctgtttcctactccttcgttccagcaattctttgtaaatttagatgaggaacaaaaccttcctcaaatatttctccaaaagaactacacattaagtaaataggttctacagataggactgccaatgccaggttttaaagttagttaggaaggtgcatctatgaaatgcttacacagtgtgagggagcaggaataggaaggggctgggataaagggagactagaggcacatttgtcttcattgatacagacccagagaagaggggcctgaaaatggaaacttatttccctccttcatagtgtaagcatagcattttcctctaccagccctactatagtgtgaatgtttgtgtcccctcaacatttgtatgttgaaatcctaacctctaaggaaatggggccttttgggaggtgatgaggttgtgagggtggacccctcataaatgagattagtgccctataaataggctcaagggagctcgtttgccccttccactggcgaggagacagcgagaaggcgccatctctgacccaggaagagggccctcaccagattctgcatctgccaacattctgatcttggacttcccagcttccagaactgtgagaaatgaattcctgtagtttgtaagctacccagtttatgacattttgttatagcagcctgaatagagtaagacactaccctaaaacttgttcagtttttagaagattcagtgagagccaagttttcttttctcactgtaatcatagggattggttcattaggtaaattaagaaaatgaaattaaaaattaaaacagaaaaggaactccaaaaacaaaaacaacaaaacaaaattcatttatcctcttcttagaatttcagccaaataaaggtatatccaagttgaacctcccaatctaaaaatctgaaatctgaaatgctccaaaatccaaaactttttgagcaccaatataacaccataagtgaaaaattccacatctgactgcatgtggcagggtgcagtcaaatgcattcgaaactttgtttcatgctccaaattatttaaaatcatgtataaaattaccttcaggctacctgtataaagtgtatataaaacgtaaatgaatttcgtgtttagacttgggtcctatcccctatcctgaagatacttcattgtgtttatgtaaatattccaaaatacaaaaacaaaaaccaaaacccaagtttaaaatacttctggtcagtcccaagcactgaagataagggagactcaacctgtatcacaaccagcattccaccttggcaaggccaacagcaagcttaaattacatatgctaatatgttctcagtctctctgaaactatggttgtcaatttgttgttttgatgttacctctaagtagtcatcaaaagtaagaaaatattgtgttacattaaggttacgctataagtctcaggagagggctgcttacgtaagcagctaaaggaaagcagcactaatgaattggtatcccatttcagttattgttaaaatatacaccatgacattcaatattcagtgttttttgaaatggtttaagcataactctttaataagatcttaaatgcccattcttatttaaagtcatttttggttttcacactaaattacgctttttttccctttacttttgcatctattaactctattccttaaattattattatttttacttttgtttctcaaggagttatctcaattttgaggaatcatgctggggcaaggattgcagttgaagtattttgcttttggagtgtataatagtatgaataattttgtgatgttttggggtttggattactttgggaagatctgtgtcattaaacatc

SEQ ID NO: 2217 - DNA, 2844 bp, Homo sapiens
gcacgcacgcacgcacgccctcgggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttgatgg

SEQ ID NO: 2218 - DNA, 1795 bp, Homo sapiens
agcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaaaaaaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatccaa

SEQ ID NO: 2219 - DNA, 1792 bp, Homo sapiens
ggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaaaaaaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatg

SEQ ID NO: 2220 - DNA, 2791 bp, Homo sapiens
ccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaa

SEQ ID NO: 2221 - DNA, 1457 bp, Homo sapiens
cggaagaagtcgggcttccagagggatggggcgcaggctggagctcactgctagcgcggcaatctcaaggtcgtccgtccttgaggttcatgttcctacctaagtcctggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaa

SEQ ID NO: 2222 - DNA, 4661 bp, Homo sapiens
aaagaagaaagtgcttcaagaaggaagtagtagtccaatgtgttgggctcctgttaaaagctcaagttatgtgaggatagtgagttgaccattagcttgactaaattctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatc

SEQ ID NO: 2223 - DNA, 1973 bp, Homo sapiens
ggggcctggtctggccaatggaagcacagagtgcaggctcagtggtcacgtgtccagcgggcgggaattttaccccaggaagagatgcaggaggcgatttttacctcagatgttgaaatttacactgctttgaaagaaagaagatatgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtgaaaatgttagattctggatttcctctaggtaattgggaaaatcactaggttctagcattccatataggccctggctctgccagaatttatgactttggatttctctaggtcccattttcttgaaaaaatgatgaagtttgactagctaaccctaaaatcttgttatgtcctaaaattctatagtctcagtttttaaatttctagccattttcatttaaagtgactttgtttccttttataaatgattaaattgctagcagtttccgttcacattggcctagacgcaaaccagcattttgcagtaactgttttttgacctaacagctgaacattagcattcaataatatcactctttaacaat

SEQ ID NO: 2224 - DNA, 4847 bp, Homo sapiens
aggaagagatgcaggaggcgatttttacctcagatgttgaaatttacactgctttgaaagaaagaagatatgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcac

SEQ ID NO: 2225 - DNA, 5058 bp, Homo sapiens
agacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagagactctgggggatgaattggagatattaagaggtaaaatgatgcagagaagaccaaggtcagcagaagtcaaatacttctatttctttaaaattttgcttaggctacgcctggctattttgaagtatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcacacaggccatttaaatgagtctccatcacagtctgaccctttgagtcaggaagtgaagatcatcacagttaaccctcccacatcaagaaagttaaaacctaggacaaaattgaagttagaaaacttccaacttaaagtatcattttctgtaaacacaatttaagaacaaattactaagaggaaatatttgcaacccagataataggaaaaaaagtttacatttctcatatataaagaattcctacaaattgatagaaagaagacaacctgatagaagaacgggcaaaatatatgaacagatatttcctcagaaaaaaacaaaaattgtcaataaacatttgaaacac

SEQ ID NO: 2226 - DNA, 5060 bp, Homo sapiens
agacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagagactctgggggatgaattggagatattaagaggtaaaatgatgcagagaagaccaaggtcagcagaagtcaaatacttctatttctttaaaattttgcttaggctacgcctggctattttgaagtatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcacacaggccatttaaatgagtctccatcacagtctgaccctttgagtcaggaagtgaagatcatcacagttaaccctcccacatcaagaaagttaaaacctaggacaaaattgaagttagaaaacttccaacttaaagtatcattttctgtaaacacaatttaagaacaaattactaagaggaaatatttgcaacccagataataggaaaaaaagtttacatttctcatatataaagaattcctacaaattgatagaaagaagacaacctgatagaagaacgggcaaaatatatgaacagatatttcctcagaaaaaaacaaaaattgtcaataaacatttgaaacac

SEQ ID NO: 2227 - DNA, 1279 bp, Homo sapiens
gggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaa

SEQ ID NO: 2228 - DNA, 172 bp, Homo sapiens
gttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagtgc

SEQ ID NO: 2229 - DNA, 1107 bp, Homo sapiens
gggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccatggagtctccctctgttgcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatgatctgcctgcctcaacctcccaaagtgctggaattacaggtgtgagccatcatgcctggcctaatttgtatatttctaatgactcatgatgttgactgagcatcttttcttttcttttctttttttttttccttgttttttgagatggagtcttgctctatagcccgggctggagtgcagtggcaccatttcagctcaatgcaacctctgcctcctaggttcaagtgattctcctgcctcagcctcccgagtagctgggattacaggcacacaccaccatgcccagctaatttttgtatttttagtagaaacaggttttcacaatgttggccaggatggtctccatctactgaccttgtgatccgcccccctaggcct

SEQ ID NO: 2230 - DNA, 894 bp, Homo sapiens
ctcgcctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgggacgacttagcttctgtattattgttgcttcctcagggggagacagtcaagaataaaaagtattctaccacctctctgcctgacttggtttcctgggatttatccctgaaagaaaacctacatctcccctaagacatcaaaggacactgggcagtaagcctcagcagacagcagagagagaggccaccctaggcaagggggcatgcctgtctcaagtcggcttctaagaggctcatgcccaag

SEQ ID NO: 2231 - DNA, 2243 bp, Homo sapiens
ctcgcctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccatggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacct

SEQ ID NO: 2232 - DNA, 2536 bp, Homo sapiens
gacacacgaatcgtacatcccgagttgggctgcttcgtgggcgcgcgactcggccccagctgcgggtcccggccgcgcacccgacgtcgcagtggaggctcccgagccgccgccagcgtcgcgacgggcaggggtgtccggtcacctgcatcaactcgaagatgtggttctcctccccgtactggggcatctcgggggggatacggtgcggggcgatagtggcgtccatgtagccgtctcggctcgccgctccctagtaaccgcgtcgctagggccgccgcgccgactgcgtcatcagcacgcgccgcggccccgccctgcaggctccgcgccgggcccagatacccgatcctcggtcgcgcgggtcgcccccgccccgacctccccggctgacgcgctctgcggctcggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccatggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacct

SEQ ID NO: 2233 - DNA, 350 bp, Homo sapiens
gtacctctggtagaattcggctgtgaatctgtctggttctggactttttttggttggaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaaca

SEQ ID NO: 2234 - DNA, 359 bp, Homo sapiens
gaaaatattttccatggaattgaacaccaacattaaaagtaaaaaggggttgggaagaagaaacctaaaaccaatgaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctg

SEQ ID NO: 2235 - DNA, 379 bp, Homo sapiens
gctttgtgggagagaggtctgtgtctgggcaaacaacctgcttgtagaggctggaagaggaaaaggccaaagacacctgaaaagaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacaga

SEQ ID NO: 2236 - DNA, 219 bp, Homo sapiens
gaatggggcttggcccccagctagacgcgagatggctcgttttcagagaacaaaggagagggaagaagataggtgttccttgaacatctactatgtgagaaacaccacccagggcactgcacctgcctgctcacaaggaagatacataatgtacagccgaatctacagtctcctattttgtcagctgcttgtgttgattaaaacttcaataaagatcct

SEQ ID NO: 2237 - DNA, 4097 bp, Homo sapiens
aaaaagtggggccgggcctgagttgggctgacctgtgaaagtctgggaaggtctgcgagagaagcggagtgttttcagctccggaagtggcagttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgagacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttattagaaaaagagtatttctccaaaaataagaaactaaatgaagacatcgaggaacagaagaaagtaattatagacctttcaaagagactccagtataatgaaaaaagttgcagtgaattacaggaagaactagtaatggctaagaagcaccaggccttcctagtagagacatgtgaaaataacgtgaaagaattggaatcgatcttggacagctttactgtgtcgggccagtggacatcaggcatccacaaggacaaagataaacctcccagcttctctgttgtccttgagagattgaggcgtaccttgacagattaccagaacaagctggaagatgcatctaatgaggaaaaggcatgtaatgaacttgattctacgaaacagaagatagactctcacactaaaaatataaaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtgcagtggtgtgatcatagctcactgcagtctcaaatgccagggctcaagcaatcttcctgcctcagcctgctgagtacctag

SEQ ID NO: 2238 - DNA, 2363 bp, Homo sapiens
tatgacaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcagatacattcatcatttcatttagaagagatggttcaccctgtagtgattcttcatctatagaatgcgaaacattcccccaggtgattctgatg

SEQ ID NO: 2239 - DNA, 4289 bp, Homo sapiens
aaaaagtggggccgggcctgagttgggctgacctgtgaaagtctgggaaggtctgcgagagaagcggagtgttttcagctccggaagtggcagttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgagacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgtctcaggtatgtctttatccaaaaaaacagacgaatacaaagccaggaggaagaacctaatgatactgatgttggaggtttcccaataaatgagccatccagatccttctccagcgaagactaaagttgttaacgtccaccttgaagctcagattctaggtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttattagaaaaagagtatttctccaaaaataagaaactaaatgaagacatcgaggaacagaagaaagtaattatagacctttcaaagagactccagtataatgaaaaaagttgcagtgaattacaggaagaactagtaatggctaagaagcaccaggccttcctagtagagacatgtgaaaataacgtgaaagaattggaatcgatcttggacagctttactgtgtcgggccagtggacatcaggcatccacaaggacaaagataaacctcccagcttctctgttgtccttgagagattgaggcgtaccttgacagattaccagaacaagctggaagatgcatctaatgagctaaacagcatgaatgatgttaaggaaaaggcatgtaatgaacttgattctacgaaacagaagatagactctcacactaaaaatataaaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagttagagtgcagtggtgtgatcatagctcactgcagtctcaaatgccagggctcaagcaatcttcctgcctcagcctgctgagtacctag

SEQ ID NO: 2240 - DNA, 6512 bp, Homo sapiens
tccggaagtggcagttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgagacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttattagaaaaagagtatttctccaaaaataagaaactaaatgaagacatcgaggaacagaagaaagtaattatagacctttcaaagagactccagtataatgaaaaaagttgcagtgaattacaggaagaactagtaatggctaagaagcaccaggccttcctagtagagacatgtgaaaataacgtgaaagaattggaatcgatcttggacagctttactgtgtcgggccagtggacatcaggcatccacaaggacaaagataaacctcccagcttctctgttgtccttgagagattgaggcgtaccttgacagattaccagaacaagctggaagatgcatctaatgaggaaaaggcatgtaatgaacttgattctacgaaacagaagatagactctcacactaaaaatataaaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcaataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaattttcttatcagttgacttttgtttcagcagaagtggcagtggatttaaaaaatttgtgcgctatcttgatgtattctggtagctctgtctccttgaataaggaaatagccaacttttttctctccaagttttatttgttatcacagttgctcatttttatgtaacatatttttaaatgttaaggaatgacacattttgggtaatttccctcagacttaaaaaaatcaataagccattttagtctctatctatcaaagttgtttcatacttgtctattttaaagcaggactgcaatgctttaataggattgagagagctatttgaaatgtatgccaatgattcctgtcatttcatggcagcccggccatggttcactgagccccctcttctctcttgtcagctcaactgaagacaagcatttagttgcaaactttaagcaggttgtgcaaaacagaaatgatgtgactgcttctcctcctgcacaataatgtcactcctggtcaatgtgagaaggtcaggttgctccttgtaaagctacatgataccacttgcccatttgaacaagttaagttaactgctgaatctggtccctgaaggcactgaaaactcattcttttagcaagtctgcatttgataagaaagtagagcaattgtgctggaggatttctgtggtatgtttaggcacttcataaggacagttcccacactaggatagcaggtaatatatttagtataagctgaaaaacttcaaggtaatggctgttttgaccttcaaaatagactccttttttgtttttgttgttggtaggacccaagagtgacacccatctttgatgctgacagaatttaaaacaaggccattgccctgcattttctgccttgtagcacacaaaagtaaaattgtatgtcaggccgagatgtcggggagctgacaagatgccccagtgacatttcagctagaaagagcaagtgtcttgcaaccaagtggtcaaatatcaaataataggtcaagcaggaaggagctgagttctaaccacaaagaggtttctggtaacttacttgacaagcttttgggtgctttgtggcttgacaaagtgatgttctgttgggtatcgctagacagactgttctttatcgccttcagaagatcagacattgacattgattaaactctttaacccttaaaggttaaatccttgcagtttgcatcatggtaagtgaagaacaaaagaatatttgtagtaagaatttgtttttgtattaatcatttaactccctagtgctattaacttctgatgtgaactatagcttttgacaaagagtcttgatacataatctattttttatattatttttcattatggaatctttcattatggatacattagagtataacagtatgtattacagaagtttttttgtcttatctttacagtgacatttgattcaaattacccaactgctgagaatttttttattggccttggtaaataagattttatactaactatttattagtagccaaattagccaagtgatttatgccatctgagggaacacagcagtattactgtcgtactgtgtaacacatcctattcttgtaatactgaaccactataattagctttatataaaactttagaaagcttatatggagtaaaattatatctttaaccaaatttctcttaattctttccttggaattatttttaatatgacctgtgtaacatgacctgtatgaaattcaacttgcaaatttattataacatggaagtgctatttattgtttttatacagatcatataatttctgcacatttcagaacacctttctctgctgttccaaacaatgattaggatattgttcatacagaaattgatagacaattttttagttcatgtgatatcactgagcttacaattctcactagagaagaacaaggttactatatgtaacctctatgtctaagtgtttgtgtgtgtgtatgcttgtgttgaatctgttttcagatcctactgattttagaggaacaagcagctttgtaaaatgtgccttggaaaggccttggtcttcttgccttgattttataatctgttaatgggataactccaaaaataaatgtgtatgtgtctccatata

SEQ ID NO: 2241 - DNA, 2181 bp, Homo sapiens
ttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattgcactaactggagagaatgaaagcctcaaagtattgtgaataatttaaaggagatgcaaatagatgtttcttcatttttcttctatcatgtaacagtatactttacaaaatattgtttttttctttaaagcctagaactagcctattaaaataatccagaaaagtgtttttaccaaggaaaaatgtgttttatggcaaagtacagtattaaaagaaaatactttcctatcagcagaggacaataagacactaggctgttacctctttaagcaagtctcaatttgttgcttttattgtttgaaaataagtaattttagaaaaaaaataaaataataaatcactttagttgtaaacatcaaaagagatacctgaaatatctcaatattaattccaaaatatatccaacatttcttatgaagtaatttaatttcagcaaagcttaaacttatctgtgttttctattgaagagtattttaccctttaatatttagttttagtgaacattgtaagatgtgcaaattgggtcatttcatttataaaacttaaaatatcaaatcataagaactcaaataactttaaagtacactaataaacttatttttagaaacattcattttcggatgctgtaggtatccttctattttatgtcactattgtattaatattattgtgatcaattttttccttaaggttatttttcttaatctgacaaaatgaaattcagtgtgtccttttaatgcccaaaaccttcattaaaaaaagaaaactatcaacattatgtaaattataggaagcatgatatttcaaaagagactgtccttgttcaatagcactctattttttagtgtatttaaaaggagaaatatctcttaaaacttagtgtgtctttcacatgttgagatttaaaataatctttttcattttagtttatgaccctgtggaattttaattttatagaaaattaatgtcagtgtgtgtgtggagcaatgttaattttttatatgctccatatcctaatttaatttgttattagtaccaaattaatgctctacaaggaaaaaaatactcattgcttctttcattagattgtccaatatgtctaaaatatatataattataaaagtaagcataaaatatttttcttctctgttatagggtagattgctgtactgttatttaagatgagatttaaaatgtgtattttaaatttgattgtcagtatttatgaattcatcattactatgaatacagtctgatttgagatttttctagtggttgtaaaataatcctttacttggctatttcaattcagaatctcacaaggcttagtatttgtcgtaatttacaagtaaagacttcctcaaaact

SEQ ID NO: 2242 - DNA, 2634 bp, Homo sapiens
cctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagttagagtgcagtggtgtgatcatagctcactgcagtctcaaatgccagggctcaagcaatcttcctgcctcagcctgctgagtacctaggaccacaggtgcgcaccaccatacccagctacttggacaaaaaacagtgtttgatggactgcctaggtgaagacctggaaaaggaagggttatctacaaatgaactgatgaagttcttcaaattgatgccgcttatataaactgaccccgatttgccctattctgcatgacaacttaagtgacagcagttagaagaaaatacagcaatgaatatgcaacttaaggattaaggaagatgcagtaaatcagtctaaagctaagtacaatgataatttcttgtaataattccacagatgccttacatttgttaaacagactgttattactctcaaatactcaaatatatgttttcattatatacatgtatttgaattgaagaagagaactaaaagttattccaacagagatcctaattcttttccctcttatttaaacttggaattatcaaaatcacagttttaaaaatattttatttaggatatccacatgcaaaagaatgaaattggaccttggtcttacaacatgcacaataatcaactcaaaatggagtacacaatgttagaaagacctaatgccataaaacaaaggaaacaacaaaatggaaaggcaacttgtggaataggaaaaactatttataaactgtatatccagtaaggagtttaatatccaaaatatataaggaactcatacaacacaataacttttttaaaaaatgggcaaaggacctaaaaagacatttttccaaagaacacatgcaagtggccaataagtaaaaaggtgttcaacaccgctaaccattagggaaatgaaaatcaaaaccacaatgagatatcacatcacaactgttaggatggctattaccagaaagtcaaaagacaacaagtgttggcaaggatgtagagaaaagcgaacctttgtgcactattggtggaaatgtaaattggtatagctattatggaaaacagtatggaatttcctcaaaaaataaaaatagaactaccatatgatccagcaatcctacttctgggtatacatcaaaaggaaatgaaaccgttgtcttgaagacatgtctacacttccatgttcattgtagcattattcacaatagccaagatatagaaacaacctaagtgtcctctgatgaatgaatggacagaggaaatgtttatacacacacacacacacacacacacacacacccagaggaaaattcagcttt

SEQ ID NO: 2243 - DNA, 4017 bp, Homo sapiens
gtccctcagcgaaggcgcgctgcttggcgggcgggctcttccaatccgagccagcgttctcggaacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcaggtaaaatgtaaacaaatattttggcctgcattttcttaatttgtgttataacagctgggaaaaacagcactgtgttcagagaacgaaggtgtgcattgagaatgggtaacatattgttatgacactcattattgtatataaggttaggatacagttgagatatgctaccttagtggaggagttggcacactatagcctacaggccaggtctcacccactgtctgttcttgtgaagttttgtcttgtccatagctacttttgtggcagagtggagtagttgtgacagagaacttacctggcagtctgcaaagaaatttgcagattggagtgttcttttacggctgtgggatggatttctttttgagaacgttgaaaaaatgtgcatgttatttattgagtgcatatcctatgcatatcactgtattaagagctgaaggtgtaaagatgaatgagctccttttgtaacttacattttgttgtcagagatactatatatctatctccagatatatagatgcttacatagaagtacaaaatactgaaatacaatgggaatataataaagaaaaggattaaatctgggaggggaattaaatggaggcctcctaaggaaattatcctttttgctatgctttagagaatgagaaggaatttctaagagaagtgagagcagggcattttattaggggttggcacactactgcccatgggccaagtctgacctgcagcctttttctgtaaagttttattagaagatagccatgcccatttgtttacatattgtttatgggtgcttgtcgagacagaccttatggtccacaaaaactgaaatatttactctgtggccctttacagaaaatgtttactgaccactgttctgaacaactgcttggataaagccactaaataaaatgtacttgtttatttttgaggaatacttgcagtgttgagtggtagagcttagggaaaagtttggagataatggtgggaaggcatgatgaagactaattatggaagtcctttttcgtgctaagaaacttagacttattttgaaagcaatggaaagccactgcagcttttgggacagacagatatgaaatctaagtttaggaaaataactctggtgccatattggtagataaaggaagggagtgaagataggaggctgggtgaagagatgatgaacacctgaatcaagacaacgactgtagcaatggaaaagagggctcctgtggcagaataacagtccctcaaagatgtccacatctgcccttatcctcagaacctgtgaatatgttaccttacatggcaaatgggactttgcagatgtgatttatttgaggatcttgagatgggagtttgtcccagtttatctagttgagactgatgtaatcataagagtccttataacagggaggcaggagggtcacagtcagaggcagagatgtgatgacagaagcagaggtcagagtaggtcaccatgaacccaggaatgtgggtggcctccagaagttagaaaaggcaagacaagatttcttccctagagtctccagaaggaatggagtcttgctgacacgtgactttagccccagaagacccatttcagaattttgacctccacaactgtaagataatacatttatgttgttttaaattgccaatttgtggtaattggtaatagcagtgattggaaaggtacaggggacaaactgagaatgcatgattttaggtaactaatttgcagtgtgaggggagggaaggagcaatagaagagaacaccaaggtttgcagtatgtgtgaaagtgggcagatgcagttgactgtcaaactctgaagtctgaagagagacaatggtaagttttgaacatgttgactttgaggagcagtttaagaggttcatagtgccctttgaggatatggtcatgcaaagttacctgaacaatgtacatttactcttgacatcctgctttttgtgaacagatcctttctttatattctctcaagcaactgccggtagcttatcttggatcagccagtttcccaggtgttaggaaagttaaggaaattacataggaggagatttgttggacctgctactttcttgattttaatattttatagacagttatgacttttcgcttaaatgttttctcagcatttgataatatgctttaaaatctaataaatatggtatttgttatgcttctgttaaagagattaactttaatgaagattgtatacctataatagtatttttgtttgcttaaatctaggaaggtagaaagtatctttatgaacttagattctcagtataaactgttaagatgttcttatttcatgttatttagctggtcagttattacatttgagcactactttgtgaacaaatgtaatagactgtatgaaaataaaatatatgcacttatttccagaagaaaaagtagttttaagcttatttggctttagcaagtttgaaaatcatctcactttatttgtgctcttgaatttcatatcaagtaggatggtgggattgccaaaatcagtaaatgaaaagtagctataagcagatagattaaaactagtttagactaaaaaagttattgccttgatttaggtgtttattatcttttcacccaacctcctatcaccactccgttactttatttgccaatgttagttaccagaattatttttctaaaacttagatttgatatctacatcaaaggctacttatattaaaagctactgctttcaatatgtctaaattacttaatttaatttacatttttaaagacttacacttttttcctatcttgttttaattaatgcaatttatagtgttttaccttattgtttaaagaactcccaatgtaagatacaactgtatttgtaaagatttggtattaaaatttatgtttttacttttg

SEQ ID NO: 2244 - DNA, 1185 bp, Homo sapiens
gctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaa

SEQ ID NO: 2245 - DNA, 2048 bp, Homo sapiens
agtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatatctgtggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaaccat

SEQ ID NO: 2246 - DNA, 1121 bp, Homo sapiens
caacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataatacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaa

SEQ ID NO: 2247 - DNA, 2050 bp, Homo sapiens
agtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatatctgtggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaaccat

SEQ ID NO: 2248 - DNA, 2503 bp, Homo sapiens
actgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaaggacgtggtgcacatcaccttcttgagaggctccttcaagtcctcgtgcgtctctctgaccctgcaccggcagatggtgcctgcgtccatcaccgacatgctgttagaaggcaacgtggccagcattttagaggtcatgcagaaattctctggctggcccgaagtccagctcagggccatgaagaggcttctgaaaatgcctgcagatcagctaggtctgccgtggcccccggagctggtggaggtggtggtcacgaccatggagctacatgacagggtcctcgatgtccagctgtgtgcctgctccctgctgctgcacctcctgggccaaggtatcattgtgaacaaggcccccttggagaaggtcccggacctcatcagccaggtgttggccacctaccctgcggatggggaaatggcagaagccagctgcggagtcttctggctgctgtccctgctgggctgcatcaaggagcagcagtttgaacaagtggtggcgctgctcctgcaaagcatccggctgtgccaggacagagccctgctggtgaacaatgcctaccggggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgca

SEQ ID NO: 2249 - DNA, 2825 bp, Homo sapiens
agtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaaggacgtggtgcacatcaccttcttgagaggctccttcaagtcctcgtgcgtctctctgaccctgcaccggcagatggtgcctgcgtccatcaccgacatgctgttagaaggcaacgtggccagcattttagaggtcatgcagaaattctctggctggcccgaagtccagctcagggccatgaagaggcttctgaaaatgcctgcagatcagctaggtctgccgtggcccccggagctggtggaggtggtggtcacgaccatggagctacatgacagggtcctcgatgtccagctgtgtgcctgctccctgctgctgcacctcctgggccaagcgctggtgcaccacccggaagccaaggctccctgcaaccaagccatcacctccaccctgctgagtgctcttcagagccaccccgaggaggagccacttcttgtcatggtctacagcctgctagccatcaccacaacccaggagtcagagtcactgtcagaggagctgcagaacgctgggctgctggagcacatcctggagcacctcaacagctccctcaaaagcagggacgtctgcgccagcggcctgggcctgctctgggccctcctgctggacggtatcattgtgaacaaggcccccttggagaaggtcccggacctcatcagccaggtgttggccacctaccctgcggatggggaaatggcagaagccagctgcggagtcttctggctgctgtccctgctgggctgcatcaaggagcagcagtttgaacaagtggtggcgctgctcctgcaaagcatccggctgtgccaggacagagccctgctggtgaacaatgcctaccggggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgca

SEQ ID NO: 2250 - DNA, 1613 bp, Homo sapiens
acgctggaggccccgcccgccgcgcgcaggccctgcggtccctcccggcccggcggaacgcgtcccttttaagggggcggggacctgggggtctggggccagcgcgcgggagggacgcctgagtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagatcaagacagaaggcgttcctaacactagaaggttcccagtcggtgaccatgattccagattgttctgccggtccctgaagttcctgtaaatggactcgtccggcatgctgccactcctgtctggtctccttccctcagcctgctgttgtgagccccgcggtgctgctgcatgcaccagcaaatcatgtgttcattgcttgctgccactctgctgcctgattgcgctgcaggctgtttacctagtctcatttgggctgcttccagtttggggctattgtgaataaggctgctatgagcattgctggaagacactcacttttctgggatgaatacctaggagtggaattattgggtcgtagagtacatgtgtgtagcttcagtggatgctccaaacagatttccgacttggtttggttggccccatgtttactctcacaagttgtgagcattcccgatccacatggaggccagcacttcattgtgtcagtcttgttgttgttgttgttgttgagatggagtctcactctgtcgcccaggctggagtgcagtggcacgaccttggctcactgcaaccttcgcctccctgttcaagcgattctcctgcctcagcctcccaagtagctgggactacaggtgcccaccaccacacccactaatttttgtattattaatagagacaaggttttgctatgttgcccaggctggtctcgaactcctgacctcaagtgatccacccgcctcggcctcccagagtgctgggattacagatgtgagccgccgcgcctagccagttcactttcttaatgatgtcttttgatgatggaaagtcctaactgtaatggagttcgctttcccaatgctgactcttatggttagtgcctttggagtttaagaagcatttcctgctccaagatcatgaagatactctcctctgtcttatggaagcttggttatttttgccttcacatttagatctttcatctacccc

SEQ ID NO: 2251 - DNA, 1855 bp, Homo sapiens
acaaatcggacttgaacaaaaacaactctttttccatgggaccaattataaaaagaatggctttgcactgagcagctcagtctactggtctcatcagtgaaaggcttgtgaaaatttctggaaagagcattggctggcttgttcatctctctgtttggtcagttgctgtgtttctgccggatcagatgagcagattggttagtgaaggtcagtgtgagaagaagattgtttctgagcttgagaagcttctggaggattgaagagtatttgaagtctgtgtcaaacatccatatcataagtggaattttggagatattcaaagaatgctgtcagaagggtatctcagtggacttgagtactggaatgacatccactggagttgtgcctcttataatgagcaggtggctggggaaaaggaagaggagacaaattctgttgctaccctttcctattcctctgtggatgaaacacaagtcagaagtctctacgtgagctgcaaatcatctggcaagtttatctcttcagtgcattcaagagagagccaacatagcagaagtcagagagtcacagtgctgcagacaaaccccaatcctgtgtttgaaagcccaaacttggctgcagttgaaatatgtagagatgccagcagagagacctacttggttccatcttcttgcaaaagtatttgcaagaattataatgacttacagattgcagggggccaggtgatggccattaattcagtgacaacagattttccctctgagagcagttttgaatatggccctttgctgaagtcatctgagattcctttacccatggaggattccatttctactcagcccagtgactttccccaaaaacctatccagcggtactcatcctattggagaataacaagcatcaaagagaaaagcagcttgcaaatgcagaatcctatttctaatgcagttctgaatgagtacctggagcagaaggttgtggagttatataaacagtacattatggacaccgtgtttcatgacagttctcctacccagattctggcgtctgaactcatcatgacaagtgtagaccaaatcagtcttcaagtgtctagagagaagaatctggagacctcaaaagccagagatatagtctttagccgcctattgcaattgatgtcaactgaaattactgaaattagcactcctagtctccatatttctcagtatagcaatgtaaatccatagagaggatgcttccattactgtctcgcatttacttaaacatgaagcaacactttatccatttattctgagaatgtgcaggaggggttagtgaaggggaattaagggctagagaagtaaagatcagctggaagtcatgtgtgaatcatggagaaatctcataatattacacttgatgaaggaatatggtaagaggagccataaggaatgatttcaaagagaggtgtgtacagcaaggaagcaaaaataaaaatgatcaaaaaagaaacggttaattcatttgaagaaacataggaattaaaaaagaagacagtcaaatgagatgaaacaaaaaggccaaaaggtggccgggtgtagtggctcacgcctgtaatcccagcatttcggaggctgatgtgggtggattacctgacgtcaggaattcgagaccggcctggccaatatggtgaaaccccatctctactaaaaatacaaaaaattagctggacatggtggtgggtacctgtaatcccagctactagggaggctgaggcaggagaatctcttgaacctgagaggcagaggttgcagtgagccgaggtcgctccattgcactccagcctgggcaacaagagtgagactcccgtctc

SEQ ID NO: 2252 - DNA, 3608 bp, Homo sapiens
ggtcgtcgacgctaatccttggccggacggatccacatctgttttctggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggttgattccatcctgtcaattggaaattgaatcagtagttaattttggcacactggttgccaatagtaaagtatattctaaagagattactatcactaaccatggcaaagctccaggcatatttaaggcagaataccacggccaattacccatcctcatttttccaactagtggtatcgtggatgctaagtcatcaatggttattaaagtagatttctgtgcagaccagccaagaattgtagatgaagaggcaatagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattgggtacagatattcaacaaagaacagatattgctttaaataatctcacctacataagaaaaataaagaacatagatactactatcattatctcctgtcttcctaatgaagggactttacaaccttatcaaaagactgtaattacattttgtttcaccccaaagctaatggctgttggtaaaaaggatattggaccttcatacagacaggactatgctctctttttgagatttgagtccgtaggaagtaaagatggatttttgagagatgatgactataaaaccatcaaaagtgaacgatttcagaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtatattgccttcgatccgtaatcccacgggaaagtttgtggtcaaagacttggcaaaacgcaagaattatgcacctgtagcaatgcttcaatcagccatgacacgcactcacaatcatcgctcatgtgaagagccagtgaaggatatgctattagcctttcccaatgaccgagctgcaactatcaggtctaaagaccatcataaacatttcaggccaattttcacaaaagttccaagatttaactatgtgaatcatgattttgcatatactacatttgaaaaacagcaaaagaaattacatgaaaactattatgcaatgtatcttaaatatttaagaagtgtgcgcttgcagaagaaacaagcagagagggagcgcatgtattcatatgatgatacagacataggcttagagccaggatcaggtctaaagtcaccctcactctcagaagcggaaatagaagaggagctgtcttcagcagcaaattcaattagagcgaatcgattgttaaccaccaggggtatagcatctcaggaggaagagtctgtgagaagaaaggttctcaaaggacttaaatcagaaccatccactccacaagaaaaacatgattgcagcttaatgttgacaccaaagcaaattcatcaagtaattgttgggccttctgtccttaactttggtaatatttgtgtgaactctccaaatactcatctacttcatgttattaatatgctacctatgcatgttttgctccagttagatactgatttagaagaacttcagaagaccaaccaattttcatacgtgattctacctacatccagtacttatatttcaatggtatttgactctcccaccattggaaaattttggaagtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggcactgttgaagcatattcctcactggaatgtgaagtaacttggcagcagggcttcagttctccagaagaaggagaatttattcttcatgtctttcaaggaaacgcgttgaagctaaaatgtgttgcacatgtaattattttccttgaacatggtttttgttttgagggctatgaatttgttgggtatacactggtgtatatagttacctatatctagaattaactgtaaaacccaagactttcatgcaacagtactagtttttttgttagagcctctataaatatgtaatatcatcatgggagccattgaaatgaaattattttattaagagacacaaaaagtattttcagagaatatacttgatggattaaaaatgtgagtagagggaaagctgtaatatgcaattttaacctttttctggtacagtccagagggccttaaattcatgactcaatcaccaagcatgattttacatgtgtaccaaatttcccactcaatgttcttagaaatattaaagaagccaaatgctcttttactaaaccccatctatatttctaggacatgatgatactcttacatatttcagctgtggaggagtttttagcctcaagagatgagaaattcatctacttttagtgatggcaagtgacagaactcagtatggtttttcttctaagcctaaaataagctgggtcctactacttttcattatgtgtaaattagttttattttttaaaaactttctattgaagtataacatgcatatgtatatgtatatgtggagaaacatgaagtgattaaataaaatattcatttgtttgtcattc

SEQ ID NO: 2253 - DNA, 2272 bp, Homo sapiens
aagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagggtctcgctctgtcacccagactggagtgtggtgtcacaatcacagcttactgcagcctctacctccaagactcaagctatctcccacctcagcctcctgagtagctgggactacaggcatgagccaccatgcccagctaagaataaaaattaaaaatatatatattgatatataaaatgagctaggaagccagcttgagagaaacctactttctcaccatcattgactctttctgttttaacatctataaggcctagaatccaggacagctccaagtaccagacagtttttcatctgtttttttgttttgttttgtttgagacagggtctcactctgtcacccaggctggagcgcagtggcactcttttgtacttttcaagcatagagaacagtgactcgctgcaacgtccgcctcccaggttcaagcaattctcctgccttagcctcctgagtagctgggattacaggcgcctgccaccacgcctggctaatttttgtatttttagtagagacggggtttcaccatgttggccaggctggtctcgaactcctgacctcaagcgatcagcttgaggagttctgcctcagtctcccaaagtgctgggattacaggcgtgagctactgcacccaaccacccactcatctgtttactaataaagtagacttggaaggtgtagttttagcatttaattccttttttttccttcacagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatttaaaaatgtttagtgacttttaaactcctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggaaactcaggtaaaggcttttaattgatgtattttaatcttatacaaagtgaattatctgaatgccaaaaatatattgaatatatacaaagggtgcataattgcaaaatacactaactcttttccccattcatatatttttttgttgtggtaaaatatgtataatataaaatttgccattttaaccatttttaagtagcatcaagtacatacagttcagcgacactaatttcattcacagtgctatgcaatcatcaccattatatgttcttttgcaatttatgtttttaattgacaagtaaaaattatatatatttatggtgttcaacatgatgttttgatgtatgtatacattgtggaatggctaaatcaagctatttaaaatacccattacctcacatacttatttttttgtattgagaacacttaaaatctactctgttagcaattttcaggtgtacaatatattgtaattaactgtagtcaccatgatgtataatacatcttttgaacgt

SEQ ID NO: 2254 - DNA, 3447 bp, Homo sapiens
atggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagggtctcgctctgtcacccagactggagtgtggtgtcacaatcacagcttactgcagcctctacctccaagactcaagctatctcccacctcagcctcctgagtagctgggactacaggcatgagccaccatgcccagctaagaataaaaattaaaaatatatatattgatatataaaatgagctaggaagccagcttgagagaaacctactttctcaccatcattgactctttctgttttaacatctataaggcctagaatccaggacagctccaagtaccagacagtttttcatctgtttttttgttttgttttgtttgagacagggtctcactctgtcacccaggctggagcgcagtggcactcttttgtacttttcaagcatagagaacagtgactcgctgcaacgtccgcctcccaggttcaagcaattctcctgccttagcctcctgagtagctgggattacaggcgcctgccaccacgcctggctaatttttgtatttttagtagagacggggtttcaccatgttggccaggctggtctcgaactcctgacctcaagcgatcagcttgaggagttctgcctcagtctcccaaagtgctgggattacaggcgtgagctactgcacccaaccacccactcatctgtttactaataaagtagacttggaaggtgtagttttagcatttaattccttttttttccttcacagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatttaaaaatgtttagtgacttttaaactcctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggaaactcaggtaaaggcttttaattgatgtattttaatcttatacaaagtgaattatctgaatgccaaaaatatattgaatatatacaaagggtgcataattgcaaaatacactaactcttttccccattcatatatttttttgttgtggtaaaatatgtataatataaaatttgccattttaaccatttttaagtagcatcaagtacatacagttcagcgacactaatttcattcacagtgctatgcaatcatcaccattatatgttcttttgcaatttatgtttttaattgacaagtaaaaattatatatatttatggtgttcaacatgatgttttgatgtatgtatacattgtggaatggctaaatcaagctatttaaaatacccattacctcacatacttatttttttgtattgagaacacttaaaatctactctgttagcaattttcaggtgtacaatatattgtaattaactgtagtcaccatgatgtataatacatcttttgaacgt

SEQ ID NO: 2255 - DNA, 6528 bp, Homo sapiens
tgtaaaaagtggatagtggctcacgtgtcaaaggatggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataagttacttgccagtttgtgagagcattattttaattttgtttgagacttatagccttggatagcacctctgtttaaacagtgtttaaagcactgttctgtgcttacaaagacagagctttcaaaattaaaatgtgaaggttgataagaacttggtttttcatgactggatgtgaaaaatcttagtacattcagttttcttgtccatatctttaaaagagagggcagccttttccttaagtgagttcatgataaggggggcaagtgcacttgattcattgctaagcaggtaataaatttgggtagatggcctgtcttgtactgtgtacaatctctataggtcaggttttccaaacatatttagcattccacttatggtaagaaagaaatgcatgcacacaggtagtatggcaactttatattgtgttaggtacttataaaatctgtcttaaattttaaaataattgatttcatttactcccatattctaggggacagtaatgagctttgaatatttaatcatttgattgacaactatgtattgcacagatactgtactaaaattacagcaatgaacaagaagacaagacacatggaccctgcctttatggtacgaagagtctaataggaaaaatggacattaaacagaaatataacttggtaaatcgcctttatagctcgctttttatttattgtaacacataaaggtaagatggctgatttactattattcattccacaactgattccctatttggatattcttttggcactgtctcaatatgcaaagcgtgttatctgcaaaatacctgtgcagaaaacattgtgtgtataagatctaaagcctaaaaggaaaaaccaactttataatttagagtataaaataaggacagggaccgtgtctgtcttgtccaccatagtatccccagcacccagcttcctatttgacgtgtggtaagagttcattaaatattagttgaataatgaatgaataaatagggaataatagaatatgtttattaggaactacatgtgtaattttcatatggagattgaacaaaaggttatccatagcattttttattgactggaaagaatttgacttcttgaatgcataagacttgagaagagaagttttttttttttttcttttttttgataagtcccctaccattgcctcctcaccttcctccactacgtgctaggcccttcgctggtactgggaagacaaagataataagacacagtccctgctgtgaggaagctcatgcactgctgaagaagagattcacaaaaacaaagaatcacaatgtagagtaagtactttagtggacatatatacaaaaggttgagaggaaagttgacatttctgattcagcatcccctcgtcatgtttctttcctattggtttcaccaacctcagaaggcactattctgttggtggttttactggttttaaaaattgatgcattgggggaaactgggtaaattgtacgcgggatctctctgtattatttcttttatagctgcatgtgaatctagagttacttcaacataaatttcaatttgaagaattgcccatagtcttatcacagagaacactattataaatattttagatgatacattttcatttttttctattggaaaaaaactcgctacatttatgtgtaacaatttatgtagatgtatactatgtaccacattttacctaataaatcctacatttttgaatagttttttttttaaaaaaaagacggggatacttccaggcagaagcaagaaaagtaaagctggatgagaaactcttattgtctttattacccagcaaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcagaaggggtaagattcaccaggactaggcatttcccaggtctcagagcagcctgggaaagccaaatcctgcagaagtcagagacacctttgactgtgtctagtgagttctggttctggacatttaatgggaacctagaagagaggggataccaggttccccaacaaagttccgtcaaataggatgattatgagctctgagtccattaaaatacagaatgaacatttaagaactgaggaatcatagatgtagaatagtatgtaaatgttataaatcttgacaaagaaaaattaatgtacattgacaaattcagacatggaggaggtaaagtgggataaagacttaagaactaaccgtctcatcattcatggccaggtgtcatgtcacgtcatgtcttaaaattataatatggggaaaaacgctagtgaccaaccttaagtttttccacaatcttttttttccttgaccttaatacagtggttctcaaagtgtggtcccagaccagcaacatcagcatcacctgagaacttgttaaaaatgcagattcttggccccaccccagacctcctgaatcagaaaccctgggggtggggccaagcaatctgtgatttaacaagtcctccaggggattctggcacatacttgagtttgagaataactggcttatttatcccttttaggaaccaatgaagaaacatttatctgaagttcagcagccccttcaatttaatgcctaattttttttctattgcattcaaataaagttaaatctaaaacttgtttgctggccgggcacagtgagtcacgcctgtaatcccagcactttgggaggccgaggcgagtggatcacttgaggtcaggagtttgagaccagcctggccaatatggtgaaaccccatctctaataaaaatacataaattagccgggcgcagtagcatgcacctgtaatcccagctacctgggaggctgaggcaggagaattgcttaaacccgggaggcgaaggttgcagtgaaccgaggccacgccattgcactccagcctgggcgacagagcgagactccatgtcaaaaaagaaaataaataaataaaacttgttagaataaaaagtttagggattccccccgtcaatcctgtctgtacatatgagtgaattgagaggtctggaaacatacccacccactgttaacactgttgatttttttaaatggtgggattatgagtgactgtactcttctgtatctatcaaatataatgaatgttgtatcatttttataaaataaagtctttcttttttaaaa

SEQ ID NO: 2256 - DNA, 1800 bp, Homo sapiens
atggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaaggtaaatacatcaaaatgtgcagggatc

SEQ ID NO: 2257 - DNA, 1238 bp, Homo sapiens
ggcaaacatcctccgagactcaaagggcaaggccatgggcgctttattccggctgctgctccaggaacgtgggaaagcagcggagttttattctaggggaaggaaacaaaggcggccgagtgccagctgcacgtttggtgggatttggtcatcaggggtggacatgctgcccaatggagctgtcggcagtttgacccagcttggtccgtcgcgtcctgttctaggaatcgattattcaaagaaggaatttagagggactgcagaaaatgttacaggtcttaacaccattttgcatttccgcaaacgaacaagaagttaatccctgtgttagtgatttctaagcccatttgccttgtggcccaagaacgttgagtttgaaatttgatgaaacttgccttaaggctcaagtacgaggccagctttcaaaaatggttttgtgccttgattgaaaacactgtatcttctagttgttggatttatcgtactctgcggctctattggttcaagcttgtgcgttgggccttttaaaatgtgtgtttcctgataattcccttcagcttgtcaactgggggtgatgtggcagggagaaagagagagaggagagagagagactgtactggcaggttttccttgtgctattcaatttttgcttcctatgttttgaagttttattattaactgcaggtttcattactgaatagatatagccaaattccttcccccaaaagattataaagtttcctagtcctaccagcaaaatcattaagttcattaaggcaaatcccctccagcgctggatgttgatgctgtctttaattttgtatttttctgactactttgtgcaattgaggattgttttggtctattggccatttggcttttctcttttgcaaatgttcatatcctttgtccagttttctttagggtgatttttccttttcgtatcaatttgtaaacagtgtacaaattacattgtacattagggatattaacagtctgtcagttacactgtacattagggatattacattagagatattaacatctttgtccattaaggatattaaccatctgtcagttacattgcagtatttttccctaaactctttttgtcttttgcattttatgtttttttaaatgtgcaattagaaaaattttatatgggctgggcacagtaatcccagcacccatctctactaaaaataaaaaaaaaaatagccaggcgtggtatctcaact

SEQ ID NO: 2258 - DNA, 977 bp, Homo sapiens
agggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttctt

SEQ ID NO: 2259 - DNA, 1201 bp, Homo sapiens
gtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatcta

SEQ ID NO: 2260 - DNA, 500 bp, Homo sapiens
gagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagt

SEQ ID NO: 2261 - DNA, 283 bp, Homo sapiens
agagcagctggacatgggggagcttgcagcgtcagcaaatcatggacactcaccctgctacccagagagaaaagggacccctggagacttgagcaaaagaaaaatgctggtacatttttaccccaggaggcacagccaccccagagccacacagcaatggatacttaagaataagacacaagaaggtagccacctgcaaaccaaaaggagagtcctttccagaccctggatctgctggcacccagatcttggacttccagcctccagaaccatgagaaattga

SEQ ID NO: 2262 - DNA, 674 bp, Homo sapiens
agagcagctggacatgggggagcttgcagcgtcagcaaatcatggacactcaccctgctacccagagagaaaagggacccctggagacttgagcaaaagaaaaatgctggtacatttttaccccaggaggcacagccaccccagagccacacagcaatggatacttaagaataagactctctgcaggaggatcaaggagtaataaaaagagcagaatatctgcagctgccaagacctcggctctaattctagatttgcagcccatggctgcacaataggcacaagaatgaaccaacgtcaccaccaaggaaagtggcacagctgagctgcacccacgtctgactccaagggaccagctattgacagctattcaccatttggtttctgtgtgtcccagtcctcacgtggaaaatgggcaaatattatctgcttcatcggtattcctgggaacctagaggaagcactagccaatatcattcacttagcataccggagttatctttccattttcttaattcaagaaccttgctctttttgccaattatcttagtagtttttcagtgacctctcagtaaaagcaatgtattttgtagccttgtctttcacagaaatcgccttataaattgtttgatatacaattaaacaaaaactttatttctgcattgctcaaagaa

SEQ ID NO: 2263 - DNA, 2814 bp, Homo sapiens
attttgatagcttcagatggatctgttccacttcctttgcaatttcttcctctccaatctggacgctacccttgtaaaattttattgaaatcaaggtatgatgtgcgtgcctattatgttgaaggtattgtgaatgaagaacaaccagaggccaaatttgagtttgaaacaccagcatttgaagcccttactcagaatattccaataaaaaatcaaacaaacgataaatggacctttcaagttactatagaaggagaatggttttatggacctgttgatttacatgttggaccagatgaaattgtggagtatcctctcacattcaaacctatttttgaatgtgtcattacgggtaaacttattctacaaaatgaagtagatggtagggagcacatctttgacataaaaggggttgggaaaaaaccttcggccttggaacacatcactgtggaatgtcaagtggggaatgtgacacaaaagcatataacattgcctcatttcacaaatactgccctaacatttaaggtaactgcagatcttccaatagtgtggggaaatccacaaattacagtatacccttataaagaaattctgtacctgattcatgtgcgcccttggaaacgtggtatattgaaaggtacaattacattttctactacaagaagatgtactacaagaaggaaacatgatgattatgaggaagacacagatcaagatcaagccctctcctgtcttgattcaataacagaacaatctagcattttggatgatgcagacacatatggtaattttaacaatttaagattctggtataatcttgagatccatagcactcctggaccacccatagagattatggaaatgacatgtattgctctggacagcacttgcattgaaatacctctctctaatccaaaagatagaggtcttcacttagaggtgcagttaacgagtgctgcccttaatggggataatgaaattatcctgagtccactacagtgcaccaaatatattgtatggtattctccagcaactacaggctacagcgatgaaagcattatttttcagcctgaaatggctgaagagttctggtatttactgaagttaactattgaattaccaaaaccaaccacaatgccagaaatacagtgcgaccttggcaagcatgtcactcagatcattcctttagttaattgtacgcatgaaaccttaaaattgcaagtaacaaacagtaatcctgaaaattttgtcctggatattaacagaaaatcacaactgatcatatctcctcactccaccacagaattacctgttctcttttatccttctgcacttggaagagctgatcatcaagcttgcatcaacttctactgtactcagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatgaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttca

SEQ ID NO: 2264 - DNA, 2860 bp, Homo sapiens
aaaaatcaaacaaacgataaatggacctttcaagttactatagaaggagaatggttttatggacctgttgatttacatgttggaccagatgaaattgtggagtatcctctcacattcaaacctatttttgaatgtgtcattacgggtaaacttattctacaaaatgaagtagatggtagggagcacatctttgacataaaaggggttgggaaaaaaccttcggccttggaacacatcactgtggaatgtcaagtggggaatgtgacacaaaagcatataacattgcctcatttcacaaatactgccctaacatttaaggtaactgcagatcttccaatagtgtggggaaatccacaaattacagtatacccttataaagaaattctgtacctgattcatgtgcgcccttggaaacgtggtatattgaaaggtacaattacattttctactacaagaagatgtactacaagaaggaaacatgatgattatgaggaagacacagatcaagatcaagccctctcctgtcttgattcaataacagaacaatctagcattttggatgatgcagacacatatggtaattttaacaatttaagattctggtataatcttgagatccatagcactcctggaccacccatagagattatggaaatgacatgtattgctctggacagcacttgcattgaaatacctctctctaatccaaaagatagaggtcttcacttagaggtgcagttaacgagtgctgcccttaatggggataatgaaattatcctgagtccactacagtgcaccaaatatattgtatggtattctccagcaactacaggctacagcgatgaaagcattatttttcagcctgaaatggctgaagagttctggtatttactgaagttaactattgaattaccaaaaccaaccacaatgccagaaatacagtgcgaccttggcaagcatgtcactcagatcattcctttagttaattgtacgcatgaaaccttaaaattgcaagtaacaaacagtaatcctgaaaattttgtcctggatattaacagaaaatcacaactgatcatatctcctcactccaccacagaattacctgttctcttttatccttctgcacttggaagagctgatcatcaagcttgcatcaacttctactgtactcagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatgaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgt

SEQ ID NO: 2265 - DNA, 792 bp, Homo sapiens
ctagaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacaggtgagttctataagggcaatagccaaggatgtttgatgcaactaaagacactaaataaactagcaagaaaaggttttactacatggtgacagataaagaataacaattttgctgtgcaaaaatcaacttatctcaactgctacatcttggtttacctttcttttgtcaaagagcagaattttaagtatggtatataacaaacagttgtcaacactagaggaaagttaaaaaaaatactttccttccatattaaggaactttagaacagacaaataatgactgtaa

SEQ ID NO: 2266 - DNA, 521 bp, Homo sapiens
tcttgctctgtcgcccagactagagtgcggtggtgcgatctcagctcactgcaacctctgcctcctggattcaagcaattctcctgcctcagcctcccagtgtataggatgtacaggatgaaaagatcccaagtgaggaccccaatcaggaggctgataaggaatgttaatctggattgggaagattccatggcactaggctgtaccacagtcatagaaagaggaactttaagaagactaaagagagcaacactgaacactttcctggacagtcctgtacatgttttattggtgatgcccaagcttatccctgaacactgggaaaagtgggaagatgtcaagagataaaagacagaggatgacagatctgagagggaccgagtgactaactttcctctgcaagctcaaagcaagaagttgactgctttttcatttgaactctgccccagcatcaacaaatcaccactctgggtttatgcaacttgtttcctaattgaataaaataagcctgaatatgaaaa

SEQ ID NO: 2267 - DNA, 2118 bp, Homo sapiens
gcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctatgccaaaacttgctaccaggccaggtgtgatggctcacacctgtaatccccagcactttgggaggccaaggcgggcggatcacctgaggtcaggagttcgagaccagcctggccaacatggcgaaaccccatctctacttaaaaaaaaatacaaatattagccgggcgtggtggcatgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctc

SEQ ID NO: 2268 - DNA, 515 bp, Homo sapiens
actgccgtccgccacgccccgcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaagggtcttgatctgttatccagactggagtgcagtggtgaatcagagcttattgcaaccttgaactcctgggctcaagcaatcctcctgcctcagcctcttgagtacctgggactatag

SEQ ID NO: 2269 - DNA, 2380 bp, Homo sapiens
catggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaagggtcttgatctgttatccagactggagtgcagtggtgaatcagagcttattgcaaccttgaactcctgggctcaagcaatcctcctgcctcagcctcttgagtacctgggactatagcacacaccacaatgcatggctaatttttttttttaatagagatgggagtcttgctttgttgcccaggctgggctcaaacgatcctcctgcttttgcctcccgaagtgctgggattacaggaatgagccactgtacccagcctatttagagttcttattgcgagtaactttttgttctagtcccttggcaggagtgtacccttgtgattcttagcctagtaaagttgttgcatcccagtataagttgagaaatatttcaggaaagaaatacgcccaagctttcccataacaccattttgggggtctgtgccataaaattcctactaaaggcaagatcctgctagcttgaggcccttctggcatatctagtatctcccatccccggattccatctgtaactcctatgtgggtcctactcgccttgcaccatctacataataattgccaacattgatgtcctggttactagcacgtgcctagcactgtgctagtgctatacctgcattctcttatttcattctcacaatatcctttgaagtagataaggacagttatcccccatttactgataaggaatctgagggtaacttgaccaaggtcacagctggcaaatggcagagctggcatttgaacccagtttgcactccaaagcccagactcttaatataatacttccatacggaacttcctcaagtcatttagaaagtgtccacttttattttatttttaaatcttcttatttaacaactcaaccactgaaatttcagtaaggaaaagaaaaaagatgccttctagttatgctttctgtttatatgccattaagacagaatggaaagcctgttatatcatatgtatctaatagcagggataatacagcccttcagttattgcccttggccaaggtttagctgtgacagtttccctacttgcattttgggctcatgaggctttaagttgaaacctcagtgcataagagaacttcagtcatcatttggaaaatagacaagtaaccattgcctttccatctcctagagttggaagagactcaggtccccctcctccctcccttgctataggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactcta

SEQ ID NO: 2270 - DNA, 2783 bp, Homo sapiens
acgccccgcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccaggtgagcacctggctcggggccttgaccaccgcccccaccccacccctcctcatccccgttcctgtcccagacccagagcgcaagtgtcctgttccctccgcgatgcggggcccaccgcgacgtccctccctcctgggcccctcctcaccgccgccccctgtagtttcagcctcagtgtcaggtgtgcgctgaatggaaaagggagattttgagacatcatgtcaacagaaatggagatgtgcactggggaaactgccggccgggccgctggcccgtggacgcctgggaggtggccaagagttggaagagactcaggtccccctcctccctcccttgctataggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggtgagttcaggcagatgatggtgttaaagaaggacagaatcacctcatctctttcatgtctattctctcatgtgaggccatcatgaacacacaacaatctaatctgaagtttgcctttgtccttattgtttcaaagaaaggacactgaggtttgtgttcttcacttaatgattcttacgtctgtgaagtaattcagcatcaactccctgtttagccaaatacacctgaagtcattggtctagaattaaatgaatcagctttataacataatcaaaaagcatttctgccttaaaatgacaccattgatgcctagctcttaccatggcattaatagcaattgactagtcaatttccataaggagaacttcttaaaatgagtaactgtcttcagcattttactttttcccccctcaaataaaaaaaataaataaaacattctctttcattttaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctatgccaaaacttgctaccaggccaggtgtgatggctcacacctgtaatccccagcactttgggaggccaaggcgggcggatcacctgaggtcaggagttcgagaccagcctggccaacatggcgaaaccccatctctacttaaaaaaaaatacaaatattagccgggcgtggtggcatgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctc

SEQ ID NO: 2271 - DNA, 803 bp, Homo sapiens
aagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggtgagttcaggcagatgatggtgttaaagaaggacagaatcacctcatctctttcatgtctattctctcatgtgaggccatcatga

SEQ ID NO: 2272 - DNA, 974 bp, Homo sapiens
gacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtaga

SEQ ID NO: 2273 - DNA, 1148 bp, Homo sapiens
gttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaggcagaggactgttctttcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatg

SEQ ID NO: 2274 - DNA, 1403 bp, Homo sapiens
ttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaggcagaggactgttctttcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 2275 - DNA, 1208 bp, Homo sapiens
gaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaggcagaggactgttctttcctgtggcgaaaagccggagtcggccctagacacccacgactcgcagggtccatggttccggaggccgtgagacctgccggggctgacaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtgggg

SEQ ID NO: 2276 - DNA, 460 bp, Homo sapiens
ctctcagcggacacctgcctccccctgctgattctcaagagtccgcgagctcttcctgcagcttctcctcgctcagctctcccacggccctgcccacaatggctgccggtctcgaggtcccctggccttggcctggttggctggcgcgcatcagggccaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctg

SEQ ID NO: 2277 - DNA, 2411 bp, Homo sapiens
agctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagagaatagcgtctcctagcagccagggcgtgcgtaggtgcgtgatgtcctcagtgcgtgtcttcgagaatgcgagattcataatgtttgctgtctatatgcatggctgagtacgtgcctcccgcgtacgtgcgtggtgtgcatacatgcgtgattgcgagcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaggcagaggactgttctttcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 2278 - DNA, 1204 bp, Homo sapiens
tgctggtatagcagctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatcccattggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 2279 - DNA, 1840 bp, Homo sapiens
gaccgctaacacctgtcactggccactggtttcccggagttagcggcaacgaccttgcagcctggacactagccaggcgctccctcttctcacagcggcccacgtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaaccagtggcttaactcatcatctgctgtatttgtcacatgatgtcacaaaggtggctctcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcagatggacccctcatgggtgactgccttctaggagatggtggtccctaccaggctgtttggcctgatctgtgtggtagcacccctcttttccaatccccccatctccttcctgctttggtctcttccaggtactcctaatgattggttgcatgtgctccagtgg

SEQ ID NO: 2280 - DNA, 1208 bp, Homo sapiens
gaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtgggg

SEQ ID NO: 2281 - DNA, 1403 bp, Homo sapiens
ttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 2282 - DNA, 1067 bp, Homo sapiens
atgacctttcctctttatcttccttgttgtgcaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatg

SEQ ID NO: 2283 - DNA, 1316 bp, Homo sapiens
ggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcaggtactctctgcagcaccagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtag

SEQ ID NO: 2284 - DNA, 1653 bp, Homo sapiens
gcagctctgggcttaaaaatcctgcctggtggtctcgtcccgcccctcctcttcctccctccggttccttttcctccttccggttcttggtctaggctgcctgtctcgagctccccggccttgtcctggttggctggcgcgggacaggatccggtaaactgaacagcgtctccttgtggcaagtgcgtgcgtacgtgcgtggcgacgtcactgcgtggcttcgtgaatacgtggcttcctagcgatttggcggtgtataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 2285 - DNA, 1440 bp, Homo sapiens
tggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattcta

SEQ ID NO: 2286 - DNA, 1653 bp, Homo sapiens; identical to SEQ ID NO: 2284

SEQ ID NO: 2287 - DNA, 993 bp, Homo sapiens
gcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaa

SEQ ID NO: 2288 - DNA, 1652 bp, Homo sapiens
cgccacgctctgcacagtctattttcggagcctagccagagacgggaaaactgaccaagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattta

SEQ ID NO: 2289 - DNA, 1926 bp, Homo sapiens
cgccacgctctgcacagtctattttcggagcctagccagagacgggaaaactgaccaaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattt

SEQ ID NO: 2290 - DNA, 1445 bp, Homo sapiens
agagggagaagtcagcggagaagctgggagctcctttggaggctgcggtgtccctgactctcctgaggggggctcactaacgggtgggtcccatgccacagtgtctgaggagaagcaggaagtgagtccctgaggagacgccgtgacctgagggcttcccttactgaggaggcctcgtgcttcatctgccacaagcggtgcccaggccggtggtgacaactgggacgatgctcaggcttctgagacttgctttggccttctacgggaggacggccgaccctgcagagcgacagggcccacagcagcagggcctcccacaaggtgacacccagttgacaactgtgcagggagttgtcacaagtttctgtggtgattatggcatgattgatgagtcgatctacttcagtagtgatgttgtgactggcaacgtgcctctaaaagttggacaaaaagttaatgtggttgtggaagaagataaaccacattatggattgagagcaatcaaggtggatgttgtgcctcgccatctttatggtgctggaccctcagactcaggaaccagagttttaattggatgtgttacttctataaatgaagataatatttatattagtaacagcatttatttttccatagccattgtttctgaagattttgtgccttataagggtgacttgttagaagttgaatattccactgagccaggcatctcaaacatcaaggcaacttctgtgaagcccatccgttgtattcatacggaagaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatccagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgcactaa

SEQ ID NO: 2291 - DNA, 1728 bp, Homo sapiens
agagggagaagtcagcggagaagctgggagctcctttggaggctgcggtgtccctgactctcctgaggggggctcactaacgggtgggtcccatgccacagtgtctgaggagaagcaggaagtgagtccctgaggagacgccgtgacctgagggcttcccttactgaggaggcctcgtgcttcatctgccacaagcggtgcccaggccggtggtgacaactgggacgatgctcaggcttctgagacttgctttggccttctacgggaggacggccgaccctgcagagcgacagggcccacagcagcagggcctcccacaaggtgacacccagttgacaactgtgcagggagttgtcacaagtttctgtggtgattatggcatgattgatgagtcgatctacttcagtagtgatgttgtgactggcaacgtgcctctaaaagttggacaaaaagttaatgtggttgtggaagaagataaaccacattatggattgagagcaatcaaggtggatgttgtgcctcgccatctttatggtgctggaccctcagactcaggaaccagagttttaattggatgtgttacttctataaatgaagataatatttatattagtaacagcatttatttttccatagccattgtttctgaagattttgtgccttataagggtgacttgttagaagttgaatattccactgagccaggcatctcaaacatcaaggcaacttctgtgaagcccatccgttgtattcatacggaagaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcctaaatagtattttatatatgacttttctggcaaatctaattgagacactggccagtccaactggaccaggaacccagcttagggaaataacttattaattaaaaagcatgctaaattagcttgctagtcactggaggaaaggagttcttaattaaaatgaacacggccattaaatttgaattccatatttcccattagcagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgca

SEQ ID NO: 2292 - DNA, 2372 bp, Homo sapiens
agattgctcttgggaatcatgccgaaagtagtgtctcggtcagtagtctgctctgacactcgggaccgggaggaatatgacgacggcgagaagcccctccatgtttactactgtttgtgcggccagatggtcctagtgctgggtgagtagccgggaactgcgggggcgtctgcaaggagccagacttcgggttcttgaaggcgaatttcctctggctgtgatctgggagccacttctcaacgaagattgactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctggctaatttttgtatttttagtagagacgggttccaccatgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtaatcctagcagtttgggaggcagaggcgggcagattgcctgagctcaggagtttgagaccagcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacagga

SEQ ID NO: 2293 - DNA, 2326 bp, Homo sapiens
aggtgcaaggcgcactcgtgacgtcatttcggggcgaccctcttcttggcgtagagttttcagattgctcttgggaatcatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctggctaatttttgtatttttagtagagacgggttccaccatgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtaatcctagcagtttgggaggcagaggcgggcagattgcctgagctcaggagtttgagaccagcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacagga

SEQ ID NO: 2294 - DNA, 1248 bp, Homo sapiens
agattgctcttgggaatcatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggaca

SEQ ID NO: 2295 - DNA, 1522 bp, Homo sapiens
agattgctcttgggaatcatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacagga

SEQ ID NO: 2296 - DNA, 2284 bp, Homo sapiens
aggtgcaaggcgcactcgtgacgtcatttcggggcgaccctcttcttggcgtagagttttcagattgctcttgggaatcatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggaggtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctggctaatttttgtatttttagtagagacgggttccaccatgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtaatcctagcagtttgggaggcagaggcgggcagattgcctgagctcaggagtttgagaccagcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacagga

SEQ ID NO: 2297 - DNA, 3607 bp, Homo sapiens
aaagtctttgcagcctcgctacggggcggagtcttgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgc

SEQ ID NO: 2298 - DNA, 3861 bp, Homo sapiens
agcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaaggtaaaaaactttattcaatggattagaacaaagtctgattccggggaacagaagaatatggttattggtggatattacccctatccaccagtgccagagacattttccaagtatagtagttctattaaagttgagtcgctcttgacagctataagtgaagtcaggaaggagattgaagacttgcagtatagggaacaaaagcgcattgcaattcaggggataattactgctataaagtatatcccccatagcagtgcgactgaaagtgcctcagcatcagaaacacttcggaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataa

SEQ ID NO: 2299 - DNA, 2880 bp, Homo sapiens
aataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgc

SEQ ID NO: 2300 - DNA, 1752 bp, Homo sapiens
aaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcgattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcaatgcttaaagacatttcagctcaaataatacagagggcttggttatctcatacaaacaaaatgatatttcgactcctaaaacacgcaatttgtgcagcggaattctatgtaacacatgaaatactgaagaaagtggcccccttagaggctaagcttattaaggatcctactatgcagtgtaaaattagattcagatttagaggtgaaacgtttccacctttcatcgtgtttaaaatttttcttcatactgatggccatggttacaagtattttagtggaaaaaatgtattaatgccgtcaagtaaggcagtggatgatgcttgcaaactaatgggggaaaggaaatttcaccgtataattatggaagatgaacgtattttcccgaagtccaaagtaactgatataatggatgttgtcaccatgcaagattatgtacaatatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggggtccatacttaactgtccaacctctatatcggccctacaaacagcaaaatcaagttaaatttctgggtcgtcgatccaagcaagctcaaatgaaagttgaaaaaatgagaaaagtttatttggctaaagaaaaaaatacttctgaggtgactgaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaat

SEQ ID NO: 2301 - DNA, 516 bp, Homo sapiens
tttcgcaaatgcacgaaatgcaagatcattactatcaatgcttaaagacatttcagctcaaataatacagagggcttggttatctcatacaaacaaaatgatatttcgactcctaaaacacgcaatttgtgcagcggaattctatgtaacacatgaaatactgaagaaagtggcccccttagaggctaagcttattaaggatcctactatgcagtgtaaaattagattcagatttagaggtgaaacgtttccacctttcatcgtgtttaaaatttttcttcatactgatggccatggttacaagtattttagtggaaaaaatgtattaatgccgtcaagtaaggtgacgtttcatgatgtacattttatgttaacttagctttttaacatctacatagtatctgaattgcattcaaattatacagaataagttatttcaccatgaaacagcccaccaggtaggtagtgtgtttttttttaagcaccatgtttcaaagtgtctccacttactagcta

SEQ ID NO: 2302 - DNA, 1228 bp, Homo sapiens
gtcatttctccagacctagctggcctgttcagtgggttatctccaccacctcaggaaagctattctgatcaaatttcttcatggcttgtattgaaaacgtccttggagggcacgccccttcacccttggtagtatctgtggacaaaaatgggaaccaggagctgcaccacgacatgcccctgcaatgtctgagttccaagccagaggatgacgcagagccctggggtcaacctcaagtaccgctgagaccttccgtcaatgtgctgactgatctggatagcaagcaactggagtggccctctgaaagaacaggatcctgcattcctcttcatagcttgagagctcatagacacccctacgggccaccacctgctgttgcagaagagtccctagcaacagcagaagtaaacagctctgatgcactggcaggctggaggcaggagggacaggatgctattaatgtgtcctgggaagtctctggcggccctcctgcactgatagtagggggcacaaaggtcaacaatgggggcactgagagaggcagtaataacgcaaggttgcatgtagctttgccacaaggtaaagggttctttccacccaggggcccacaagtgagaggcccttcacatattcccacccttagatcagggatagtaatggaggtgccgcccggaaatacacgaatagcctgcagaggaaagctggctcatgtttctttcccactcaggggcccatgccaccccatgcataattggccaaggcctatcccgttgtcttccagtactccaggtttaccttcttgctctactgttcattgtttcatccctcctcgacctccgattttcaatccctttctcactatgcctcttccttttgctcctcctccgatatttggtcctccactgccttcttattttgcccatttccattctgggggaatgccagctcctgcatcacccaacagagagcacagctgatggcaaaaaggaaggatgaaaaaagggttgtggaaagaggtgaaagttattcatttatgcttttatatttgaaaccttgtaccctcccacactctgtttagcactaatgtgccctacttgaaaccacgtaccctcccacactctgtttagcactaatgtgccctatttgaaaccttgtaccctaccacactctgtttagcacaaatgtgccctacatactggagattaaataaagattgtgaagtctgaaa

SEQ ID NO: 2303 - DNA, 600 bp, Homo sapiens
gcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaagtaaagttgcctaaaacaaacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaa

SEQ ID NO: 2304 - DNA, 766 bp, Homo sapiens
ctgtccagcctgggcatcctcagcctatgaaatccatctgcctctctagtccaccaaccctataggcctatttgccccacacaaggcctctagaacaccctccttctgcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaagtaaagttgcctaaaacaaacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccggtaagacttgccaaatgtgatctgccccagcacccccctctccctaccagccgactgaattccaagcaatcaggacgatcagacaaaaagaagtccactcgcaagtctccgacctttaggaacagaccagacttcaggaagaataaaggtcgccaactcaataaaaccaccaagcaaaagaagta

SEQ ID NO: 2305 - DNA, 1921 bp, Homo sapiens
ggactggctgggctccacccaccttcttgctctaccagttcgcgctctcctccggcagaagtagcagctgcgctcttgctctctgggggagaacctggcgttatggccactcagtcagacatggagaaggagcagaagcaccagcaggacgaggggcagggagggctgaacaacgaaaccgcccttgcctccggggatgcctgcgggaccgggaatcaagatcctgctgcttccgtcaccacagtctccagccaagcatctccctcgggcggcgccgccctaagcagcagcacagccggttcttccgctgcagccgccacctccgccgccattttcatcaccgatgaggcctcggggctgccaatcatagctgctgtgctgacggagaggcattctgaccgccaggactgccgcagtcctcacgaagtttttgggtgtgtggtgcccgaggggggcagccaggccgctgtggggccccagaaggccactggccacgccgacgagcacctggcccagaccaagagccccgggaacagccgtcgtaggaagcagccctgccgcaaccaggctgccccggctcagaagcctccagggcggcgtctgtttcctgagcctttgccgccatcttctccagggttccggcccagcagctatccctgttccggggcttctacgtcgagtcaggcaacccagccaggccctgcactcctaagccacgcatctgaggcaaggcctgctacccgaagccgcatcaccctggtagcttctgctctccgcagacgtgcatctggtccaggccctgtcatccgaggctgcaccgcccagccaggccctgcttttccacaccgcgccactcatctagaccctgctcgtctaagccctgaatctgcgccaggccctgcccgccgaggccgtgcatctgtgccaggccctgcccgccgaggctgcgattctgcgccaggccctgcccgccgaggccgcgattctgcgccagtctctgccccccgaggccgcgattctgcgccaggctctgcccgccgaggccgcgattctgcgccaggccctgcccttcgcgtccgcacagcaaggtcagacgccggtcatcgcagcaccagcacgacgccaggcactggcctccggagccgttccacccagcaaagatcagcccttctcagccgccgctctctgtctgggtcagctgatgagaatccttcctgtgggactggctcagaaaggcttgcctttcagagcagatcaggctctcctgatcctgaggtcccaagccgtgcttccccgcctgtttggcatgcagtccgtatgcgtgcctcctcaccctcaccccctgggaggttcttccttcccatccctcagcagtgggatgagagctcctcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgttt

SEQ ID NO: 2306 - DNA, 1534 bp, Homo sapiens
ggcagggcgccagtgaccgctggggccagagccctgccgggaaaggagggcttccgccttgcagcgcagctcggatcagcagcagcccaggaggcctcccgcccgtactttcccgcgtccatccctctgtcccacggtcggtgagtcagcggagcctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaataaaaaaaaaaaacggggaaaggtaactaaaaacttaaggaaagataaactgaacaagaatggctcagacagcaggcaaatctccccaattagaaacgaagtgaatagacccaattgaatgagatgaattctaagcaatagatggattgaataataagctggaggacattaataacatgttctggaaggcatacatttcttcaacccaaaggaaaaaaaatgacagaaagaaactacagggaagaacattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagccaacagaagagttaaaaattagtgatatgactatattcagggggaaggagagctgaggggggcggcaggaagtcagcagaaaatgcctcatgtcattaagtcaagaaatagtaataaaggcatgttattgaaaaagggggtgtaatctctaaacaagcacgtgtagaagtttgtgtttctgatttggggaagcaagagttgagaaggagggacagttctattacttttcattatatgtcctttttctactgtttgatttttaaaaactatacacatgtattgcttttgcttcgattaaaaatcaagacattaaaatg

SEQ ID NO: 2307 - DNA, 1045 bp, Homo sapiens
ctttatctccgccggactcggggtacctgccggattcgaggtaaccgccagctggtgtggggctggtttccccaacatctggtggccaacgcggggctccccataatctctacaaataatccagtgaaggaacgccagagcgtgcaaagtggaggacgactgacaaaggacacctgaatatgttttcacttcaagctctacaggaggacaaggactcaggggtctgctggtccatctctgcaccttgaaacagcagctggggcaccagaagtaacccttacagccaacaccatgtgatgatgaggaggagtccatctgggttaaagagcccacgtgtgagccaaggcaggaaaccccgggatccagaaagccttctgtttttgcgatgctgcctgggatcggagccgcacaacctgtcctcattgctctctccggaggccgggcaggaacctctgccaaagcttctacctcagccgctggcaggccatgcggcctggggcattcacggagttccaacgagtctgttactggctggggagtgctggggccagggcatggccgtgcccgctgatcctcctcctgcctctccatatcggacttctcctcgaccaccacctggaccactgccacgatatcgtccacagcagcaccttctcctccccctagggcgcctccacgctctgtgccctggctgtcctctccagcagagcctccaatttgaacggggtacactgtccgctccacgtctgtggtcatggatgaagctggaaaccatcatactaagcaaactatcacaaggacagaaaaccaaacaccgcatgttctcactgataagtgagagttgaacaatgagaacacatggacacagggcagggaacatcacccaccgaggccggtcgcgggggtggggggttgagggagggatagcatttggagaaatacctaatgtaaatgacgagttgataggggcagcaaacaaacatggaacatgtatccctatgttacaaacctgcacgttgtgtacatgtaccctagaacttacagg

SEQ ID NO: 2308 - DNA, 878 bp, Homo sapiens
acaggaggacaaggactcaggggtctgctggtccatctctgcaccttgaaacagcagctggggcaccagaagtaacccttacagccaacaccatgtgatgatgaggaggagtccatctgggttaaagagcccacgtgtgagccaaggcaggaaaccccgggatccagaaagccttctgtttttgcgatgctgcctgggatcggagccgcacaacctgtcctcattgctctctccggaggccgggcaggaacctctgccaaagcttctacctcagccgctggcaggccatgcggcctggggcattcacggagttccaacgagtctgttactggctggggagtgctggggccagggcatggccgtgcccgctgatcctcctcctgcctctccatatcggacttctcctcgaccaccacctggaccactgccacgatatcgtccacagcagcaccttctcctccccctagggcgcctccacgctctgtgccctggctgtcctctccagcagagcctccaatttgaacggggtacactgtccgctccacgtctgtggtcatggatgaagctggaaaccatcatactaagcaaactatcacaaggacagaaaaccaaacaccgcatgttctcactgataagtgagagttgaacaatgagaacacatggacacagggcagggaacatcacccaccgaggccggtcgcgggggtggggggttgagggagggatagcatttggagaaatacctaatgtaaatgacgagttgataggggcagcaaacaaacatggaacatgtatccctatgttacaaacctgcacgttgtgtacatgtaccctagaacttacaggataataaaacaaaaaaaaaaaaaaagaaaaaa

SEQ ID NO: 2309 - DNA, 686 bp, Homo sapiens
agatgaacaaattggggcacaacgaacttaaggaatgccttaagactgccactgattctctacagacagtgcagcctagtatctcccagacttgtacttcctatggccctgcacttggggccccactgcctggtagaaatgaagtggccttgctaacaagtttacctccaaactatgagatttcagaaggaaaaccaagagccatctctgcatatgtgagagcgggcaaaggaaatgtgacaaggagaagaaagaagacacacttgggcaatgatgatgggaagaaggaagcacaggagaaaatgtaagaaatgtacagcccatgaggaagatccaaagagaactttggccttaactaagcttcctacattctcctggagtcggtggtttatgaatgtggtgccatctggggaactgacaacccctgatgtgttcactctgctcgtcttccaggtgagagaagaagaaggcgagaaagaaagagaagttccagaatttcacaggctgagggagatggtagtaacttctgtttatgttggtttctgtttattggtttgctttttattttgaactcgtttgacttcaggttccagatttgtttttttctttgtaaacgagactttgacattgttagcaggcccatctgtttgcttttcttaaataaaatgtaaattggtttttgtttt

SEQ ID NO: 2310 - DNA, 306 bp, Homo sapiens
atgaacaaattggggcacaacgaacttaaggaatgccttaagactgccactgattctctacagacagtgcagcctagtatctcccagacttgtacttcctatggccctgcacttggggccccactgcctggtagaaatgaagtggccttgctaacaagtttacctccaaactatgagatttcagaaggaaaaccaagagccatctctgcatatgtgagagcgggcaaaggaaatgtgacaaggagaagaaagaagacacacttgggcaatgatgatgggaagaaggaagcacaggagaaaatgtaa

SEQ ID NO: 2311 - DNA, 1468 bp, Homo sapiens
gcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagac

SEQ ID NO: 2312 - DNA, 2575 bp, Homo sapiens
gattgtgaataagggatgttttctctcctgtctctctcccagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagattggaccatgtggaggtagggagaatagaatgtcatgttctttcactgaagccatgccgtgagcaactctatccaaatagaatgtcacacctctcagttggagacccaggaggactgaccgtgtgccaagagtgaggacaggaggtgattacagcttactagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttc

SEQ ID NO: 2313 - DNA, 1847 bp, Homo sapiens
actgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccag

SEQ ID NO: 2314 - DNA, 1468 bp, Homo sapiens; identical to SEQ ID NO: 2311

SEQ ID NO: 2315 - DNA, 3381 bp, Homo sapiens
aaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgagggg

SEQ ID NO: 2316 - DNA, 439 bp, Homo sapiens
atgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaa

SEQ ID NO: 2317 - DNA, 2629 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaa

SEQ ID NO: 2318 - DNA, 2632 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaa

SEQ ID NO: 2319 - DNA, 377 bp, Homo sapiens
tgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagacaaattataaaggcccacaaggttctgcaacgttgttcacttatcctcttctttgtccgtgacctctgctcatcacagctggaactcaccggagtttctgccggctcctccgggatctaccgcgtgatgctgggccagcataacctctacgttgcagagtccggctcgctggccgtcagtgtctctaagattgtggt

SEQ ID NO: 2320 - DNA, 887 bp, Homo sapiens
tcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctgcctttggctgcaacttcatctggaagcccacggtgttcactcgagtctccgccttcatcgactggattgaggagaccatagcaagccactagaaccaaggcccagctggcagtgctgatcgatcccacatcctgaataaagaataaa

SEQ ID NO: 2321 - DNA, 497 bp, Homo sapiens
gagatgaggtcttgctatgttgcccaggctggtctcaaactcccgggctcaagcgatcctcccgcctcggcctctcagagcactaggattacagcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtga

SEQ ID NO: 2322 - DNA, 649 bp, Homo sapiens
atcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtgggtgagtgaatgctccggtctggaacccaggggctcctctacttgtccctccatgacccacagccaagtctgagtaggctccaactctgagtagggacgtagggacatagggacatagggacaggggagctgagtccagcagcctgtgcccaggtcccacacactgaggattgaagccagcagagcctttaaggaccatcaccaccaaacctgtctccctacagaggggatggcagtgttcagggaggggcaggaactctgccaaggccactt

SEQ ID NO: 2323 - DNA, 357 bp, Homo sapiens
tggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctgcctttggctgcaacttcatctggaagcccacggtgttcactcgagtctccgccttcatcgactggattgaggagggaggatagagagacatgccagacaagaggctgcctggtgggggacagaccatagcaagccactagaaccaaggcccagctggcagtgctgatcgatcccacatcctgaataaagaataaagatctctcagaaaattc

SEQ ID NO: 2324 - DNA, 585 bp, Homo sapiens
ggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 2325 - DNA, 478 bp, Homo sapiens
atcaactcactggtaacaacagtattcatgctcatcgtatctgtgttggcactgataccagaaaccacaacattgacagttggtggaggggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 2326 - DNA, 1777 bp, Homo sapiens
cgtgaacttcgtttctcctctccctagcctgggcttatttctcactttagccttcggaatgctttcgaaactgtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaa

SEQ ID NO: 2327 - DNA, 663 bp, Homo sapiens
atggctttaatctttagaacagcaatgcaatctgttggacttttactatctctcctgggatggattttatccattattacaacttatttgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctcattctgggaggaattctgtcctgggcctcgggaatcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctcaactgcgcagcctgctccagccacgctcccctagctttgggccactatgcagtggcgcaaatgcaaactcagtgtccctacctggaagatgggacagcagatcctcaagtgtaa

SEQ ID NO: 2328 - DNA, 1822 bp, Homo sapiens
aaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 2329 - DNA, 4163 bp, Homo sapiens
cacttgtgctgagctactggctgatccccaaggacatccttctggcctctccttcacacctgggtcccctagccctgcatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 2330 - DNA, 647 bp, Homo sapiens
gctatattgggcccacctgcctgggttccagcagcttccgcagccccagcaggagacggaagatgcaagaggtcattgcggggctagagcggttcacctttgccttcgagaaggatgtcgagatgcagaagggcactgggctcctgcctttccagggcatggacaagtcggcctcagctgtgtgcaacttcttcactaaagggctctgtgagaaagggaaactctgccccttccgacatgaccgaggggagaagatggtggtatgcaagcactggctccgggggctctgcaagaagggtgatcactgcaagttcctgcaccagtatgacctcaccaggatgcctgagtgctacttctactccaagtttggtgactgcagcaacaaggagtgttccttcctccatgtgaagccagctttcaagtcccaggactgtccttggtatgaccaaggtttctgcaaggacggtcctctgtgtaaataccgccatgtccccagaataatgtgtctcaactatttagttggcttctgccccgagggacccaagtgccaatttgctcagaagattcgggaattcaagctgctgcctggaagcaagatctaagcgttgcttcttacctagcggggcactccaatgccacagacaggg

SEQ ID NO: 2331 - DNA, 1275 bp, Homo sapiens
gggtgtcaggggccccagagggagaccccttccctcatgggaagaagcggggaggtgggacggctccctccctctgcaaacccccaccacccccagctctggcagaataacagccttgctgcggttggtttgtgcaactctttgctaacctgtggctgtgtcttcatggacaaagtatgagcccaggtttggtaatgtctgtgtgcacgccacgtttgtgttcggtaacatgcaaagataagcaagtcggcctcagctgtgtgcaacttcttcactaaagggctctgtgagaaagggaaactctgccccttccgacatgaccgaggggagaagatggtggtatgcaagcactggctccgggggctctgcaagaagggtgatcactgcaagttcctgcaccagtatgacctcaccaggatgcctgagtgctacttctactccaagtttggtgactgcagcaacaaggagtgttccttcctccatgtgaagccagctttcaagtcccaggactgtccttggtatgaccaaggtttctgcaaggacgcaggtcctctgtgtaaataccgccatgtccccagaataatgtgtctcaactatttagttggcttctgccccgagggacccaagtgccaatttgctcactgtagcttgccagccggccccgggattcagcacctcctatttctgctgtggaagcttggaaacccccatccccaacagagtgcctgctctcctgcctggggatcaggggtcaagggcagggcctgtgccacagggccattatgccagtaagtacagtaagactcaactgataggagttattaaaaactaacctatggtcaggagaagatgctcaatggtcttactatgggattctgtttcccaagttccacagtaagcctgctgtcatcctaagcagggtatgagtgaggtgcagaagtagcctgtggcaggcaggtttatttcttttgatcctgtaagtgaacgagctactaaaaatacaacaggtttggaggcagattggcaggaacgagttatccataaaacgggagcaaaatgtacataaaaccaaaagctcgagtctatgggaaatccacgatcattatactttgctcagctcctaccaacaggtctgggttgcacgtggcagctcctctgtatatggcttcagctgccgctatcaactggcaattaactcaaatggctttctttagcatgacagctgcttccctgtatggcttatttaaatctaagaatatactctgtaccttatgt

SEQ ID NO: 2332 - DNA, 757 bp, Homo sapiens
atgaatcgctaccggagccgctgacggttcggacgtgcagttctccctgcttatcctgtagggcgtccaacctggtggactcatgagcaaagagatattcccattctgccgagtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttg

SEQ ID NO: 2333 - DNA, 2038 bp, Homo sapiens
cggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaaggaaccctacagcactcgcccgtgggacccgccgggcctgcatcaattgagcgagttcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgc

SEQ ID NO: 2334 - DNA, 1056 bp, Homo sapiens
tttagtgtcacaggagacacgagggcaaagtgctgaggaaactctagagcaacatcggaatgcatggtgaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgt

SEQ ID NO: 2335 - DNA, 794 bp, Homo sapiens
tggaaaatccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagccaagcgg

SEQ ID NO: 2336 - DNA, 1557 bp, Homo sapiens
ggattcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtggagtgatcatctccaactcaactcaatcacactgcctaaaatcggcactgacaaagtacaaataatccacctatccagtagaggcagcactgatctggctgattcctggatatggggaatcctctttatgaaacaaacttacaataagaaagaatatgtttgtgggagctctggctgctcttcttgattttgctagctaagagtaaagtggttaagagagtcaggattagagtgttctggattcatataggttctgtcccttcctggctatagggcagctaggtttcacttactcctctctataagagaaatgatcatcttttcctcctagggttgaagactgactgagacaatgcctcctgcacagtgttccattttatatttagtcatgaacaaacaacttcagacacaatattggaagatttgggcagaaaatactacc

SEQ ID NO: 2337 - DNA, 2762 bp, Homo sapiens
agacttctgctggcagttactgagagagataggctttccatccatggcagccatttacttttgctctgggagacgtttgtaatagaaaaggcacaactggggtatttattcatttccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccatccctctatgccggaagtgtgagacgcgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcgacctcagcaagaaagaggggaaagttgtgaagtcctccttgaaccaaatgttggataaaacagtagaacagaagatgaaagagatcttgtattggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttccttggggcagcatctaaccctgaggaaccatggaggaattcactccggtgtatatccgaaatgaataggctgttttctggaaaagcagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagaggaattgatcctaattatgccaataaggtttctatcccagttcctaaaatggtagatgacgggaagagcatgcgtgtgaaacatccgaagtggaagttgagaacgaagaatgagtacaacctgtggactgcataccagaacgaggaaacgcagcaggtcctgatggaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtggagtgatcatctccaactcaactcaatcacactgcctaaaatcggcactgacaaagtacaaataatccacctatccagtagaggcagcactgatctggctgattcctggatatggggaatcctctttatgaaacaaacttacaataagaaagaatatgtttgtggg

SEQ ID NO: 2338 - DNA, 766 bp, Homo sapiens
cgctcaagagagcaagatgttctcgtgttgcttccccacttcgagaggttgctgcttcaggaatggagggagtgagagccttttccgacgatgccgaagaaggctcatccctcaccccagacgcctgtcgcccgttgtaataaggcgcatccaggtaccacaggacagcctggggcaggccctagcaggccaggccacaccagagatcccattggggctgcagctgcacactgtccttgtccaggagattcaggagctcattgaggcacagacacttgctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttca

SEQ ID NO: 2339 - DNA, 655 bp, Homo sapiens
acttggtgggagtcgctcaagagagcaagatgttctcgtgttgcttccccacttcgagaggttgctgcttcaggaatggagggagtgagagccttttccgacgatgccgaagaaggctcatccctcaccccagacgcctgtcgcccgttgtaataaggcgcatccagctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttca

SEQ ID NO: 2340 - DNA, 1048 bp, Homo sapiens
gagacgctcaagagagcaagatgttctcctgttgcttccccacttcgagaggttgctgcttcaggaatggagggagtgagagccttttccgacaatgccgaagaaggctcatccctcaccccagacgcctgtggccctttgtaagaaggcgcacccaggtaccacaggacagcccggggcaggccctagctggccaggccacaccagagatcccatcggggctgcctctgcacattgtccttgtccaggaggagattcgggagcccatggaggcacagacacatgctcctggtccgtacgcagacatagcagcacttgcggcaccggctgtcgagccaaagccagcatgggaagagccccctccagagagagcgctggaggtggagggagctccagccaaggaccagcccagccaggagctgcctgaaatcatggcacctactgtagccactggccttaatgctggagctgaaaacgtggctggagagagaagtgggagggagggggtgacaagcacagccccagccagcagatcccatgctgcccctagtcctgggcatggtggcaaacatggaggcggagaccagggcattcagactggactcctgtacctcgctggagagaggcttctctcattcgccggaaccacagccctgctgctgcagggcctgtttattgtgctaattctggtggggtatatctctgtgaaggtgatgctcaagagcattaaaacaaggctgggaagaagagttccagcagctcctcctgctctcagacgcaatcttctcctccaggcatggaagtgtgtctgcaactgggcatccaggctgtttgcccctaatgtgctgccccgaacgggctcttaacaggtgggcaggggttgaggggaccaggaggtggctccaaagggtacagcaaggaaagcttttaaagacagctgttgtgctccaggctctccatgccaccacctgccctagcatttattaatagtgttagaattacaagtttatgaaatgaaatataaataaagtttgatttctgaaacttc

SEQ ID NO: 2341 - DNA, 2489 bp, Homo sapiens
aggggcaagaggatggttagctgcagcaaagagagagccaaagagaagtgggattgagagcacaggggacagctggagacaaaatataaacgccgggcaggggaacagccaagatagtgcaggaaggatggggaatcacagaaacttctcaggaacccagtgaaatgagctgcaccaggaactttaagagagagttttcagctgggagaagaggaaggcaagatatcagaacaagaatctgaacctgtgatgttaagaaatcagtaaatattaaaaagaagatggatgcaagaaggatgaagaaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatt

SEQ ID NO: 2342 - DNA, 2503 bp, Homo sapiens
agcggaggggcaagaggatggttagctgcagcaaagagagagccaaagagaagtgggattgagagcacaggggacagctggagacaaaatataaacgccgggcaggggaacagccaagatagtgcaggaaggatggggaatcacagaaacttctcaggaacccagtgaaatgagctgcaccaggaactttaagagagagttttcagctgggagaagaggaaggcaagatatcagaacaagaatctgaacctgtgatgttaagaaatcagtaaatattaaaaagaagatggatgcaagaaggatgaagaaagaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataattttttta

SEQ ID NO: 2343 - DNA, 632 bp, Homo sapiens
gacattctaatgtcaccaatttttcgacatgctaatgccagcaattttttttgaaagttgaaatagaacataataaggcaacaaaacgagactaagagggttctgcaccgtgttccaacaatcttcagtccccttcactgttcatgtctaagcactgaggcgttctaaagcaggtcaccttttgcctcaaggacttttcttgaaatatcatggtcttgctctgtcgcccaggctggagtgcagtggcgtggtcacagctcattgcagcttcgacttcctgggctgaagcgatcctcccatctcggcctgtcaagtagctggaaccacaggcgcgccactacacctggctaatttatttttattttattttttgtagagacggtctcgccacattgcccagactggtctgaaagtcttgggctcaagagatcctcccgcttccgccttccaaagcgctgggataacaggcgtgagccgctgcccgggccatccctcgaggaagtttcatcaggaatctgaacctgtgatgttaagaaatcagtaaatattaaaaagaagatggatgcaagaaggatgaagaaagaagaaggactcacagaaaacactggacttccccggaagctacttgaaaa

SEQ ID NO: 2344 - DNA, 886 bp, Homo sapiens
atgcagcggcccgagtggccacgtccgcacccgggggagggggccgcggcggcaggccgggggccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgcc

SEQ ID NO: 2345 - DNA, 3868 bp, Homo sapiens
ctttcggttcagcttccccagccggaccccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagagagattgctgggtcatggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcaga

SEQ ID NO: 2346 - DNA, 4898 bp, Homo sapiens
cggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtata

SEQ ID NO: 2347 - DNA, 9367 bp, Homo sapiens
cggcggcggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatacttgtagtttataattataataaaataatgttttaaaggtcacataggatttagggggctatgtatataaaccattaatacatgtatgttctgaaaagttgccttatcgacaccattttaggagaacatgtgctatcctgtcaatggggaaagaaatttgtgacaagtagttttcactcatcatatcctaaaataacagcacaaggaagatacaggaatggtctagaaccaacttttgactttcatgtataatttttagcatctaggcattttgcttttccttctttcctccaatcaagttatttatttatataatattaaaattataattcagattacatatatatgatagagtataaaatacattctttttcatccccagcatcccactctcctctccaaagatagctgttaatattttgatatgaagccctatatagatgtatttatatgaagtacatgtgtgcaggtttgttgggggcttttgtgtgtgtgtgtgtgtgtgtgtgtgtgtgtgtgtatgtgtgtttcttaacatgaaaggaggtcacactctaatactatgtaacaacttgccttttataccagcagtgttctggaagagcttttctttttacacatacagatcgatcgtatttctgttagccattctattgtttcttgctgcggtacataatgttggctggagtgaagagattggggttcagatcacaagtctgccacttatgagtcatgggatcttgggcaaattactttctctatgcttcattttctcttctgaaaaatgaattaatatgaataaaaatgaaccttattttaaaaacggcaggcaattcatcttttaaagttacctgatgtcaatactataagtgaacaggtattatttgcctaatatactccctattctttgaggagtgacccttcttccgatttcacctcttcatgaactgccagatctggccttggccactaggcactggcaacagcatacacactctgtcatcttatccaagtccttgaaatgagaccaatctttgtcctgagacttagttacttataggtgcttaaaacccaaagcgtcccaattgatacaattatgtatgtgtctaattccagtttactttgtacccactaccagtagagaaaataagtatcaaagaactaagaatcaaactcatcatttttaaaatctactgattttgataactgacttgaaagaaaagaacttgcaattagaggtcatagtgaagatttccagggtcaaagtgatttctgaggttttagatgtaaaaatatctcctatttatttgctatttcagagttgacaacaagatttttatttgatccacatatttaaaaggtgtgcaaagattgctactttacaaaggtcacagaagcagaggagtctcagagtcccacatccaattactaatttgttcttccccatgactaaatgtagcaaatgatgaagaaactggtgctagatttcaagggataccagaataggaagttatttgttctgaatcttcagttggttttccttttctcttaaatgttaccactttcctgcaaatttccatccttaatatgttagactgttcatatagatacattgtgtttacaacaaggaaaaaatgccaccatgtgctcagaacttttttgacaggtattttgagaagagttgtggaacattctggtaatttgtagagatctgttggcatctctgcttcacaaactggaaaaaatcatttgtaagtcttgctaattacttttcttggagaagaaaaaaaatgctacagttgcaaacaaatgtatagttttcaaaaagaagcaacttttttgctccccagtttattcttagtttccagcccacgccttgcgatagcgataggcatagtgatggcctcaattctttctctcttgcatccataccttttgctgtgatagcagtgatggcctcagttctttccctctcttgcatccgtaccttttgctgtgtgactttgcagctcctctcattaaagaggcagagccccctctcccacccataggagcaggttttgagagtaacagaatgaagtgaaaatgacactgtgccagttctaagaccagccctcaaaggttcatgtgtttctgcttgctttcactgtatttgaaatgttgctgtgagaaagacatctctgaaacagctgaatggtcctaagaaaaggatgagagatgcagggagcagagctcccaactgaggccagcctagatcacctaagagccaggcccccagtttactctgatgtgtaagcaataaatgcttaccccagcaataccaccaaggtttgtggttggtttatatacagcattaatgtggcaataggtgcaatacaccctgttaaacaaaccatacacatatgactctaaccctaatcataaattgattcagtctgttcagttccacaacgctgtttcctccagaatctcacagatgacttactaaatccaacacaaatacacctcagactttctgtctagctcccaaccagttaaaagcaattctaaatattttttttcttagtcgtagtgcaaaagtatattctctccctttctctatagttttctctcattttgtcttcagacctagaagcatgagagcccagctgtcaaagtcatctagacccccttcagaaggtcattaaatttgtctatttcacaggattgcaagataaaatacagaatgcccagttaaatttgaacttcggataaacaacaaatttttttttagtataagcatatcccatacaatatttgggatatacttatatttttatattgtttatctgacgttcaagctaactaggcatcctgtatttttcttagctaaatctggcaactgtgctatttcattgaaaacctgaaagtgtacaaagaaggaagaagcagaatctgccatatgagtaatagaagtgagcaggcccaggactccctaagtcaagaaaccaagaggcgtcattacggaaaagagtaactcaccctgtgtgctccttggtagttctccctcagcgatgcccccatgttatgaatggggaaaagttcactgaagggttcatagtgaagaaactttttggatgatttctgttggtgggttttggataccttcaagggatcagaaaataatatacttaggaaattttggtaatgtcatcattactctctacattattattatgacggttacaattgttaaatctaggtggtgggtatgtgggttatattgtacatgatttttaacttgtctgcatgtttgaaattataataaagtcaataaataaattattgagacactcctg

SEQ ID NO: 2348 - DNA, 4749 bp, Homo sapiens
cacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactggg

SEQ ID NO: 2349 - DNA, 4636 bp, Homo sapiens
cacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactggga

SEQ ID NO: 2350 - DNA, 575 bp, Homo sapiens
gagcctcgcaggggttgccgcttctccattcaagtcctggcttgagagccgagcggcaagagcgcgggccggggaagggaagagtaggagaggaagccgcgagggagaacagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctac

SEQ ID NO: 2351 - DNA, 549 bp, Homo sapiens
aggaccagaaggaggacagcaaaaagtgcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacag

SEQ ID NO: 2352 - DNA, 1136 bp, Homo sapiens
atgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 2353 - DNA, 1791 bp, Homo sapiens
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgtta

SEQ ID NO: 2354 - DNA, 1143 bp, Homo sapiens
cagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtata

SEQ ID NO: 2355 - DNA, 585 bp, Homo sapiens
ggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggtaagtaaagttcaataaatgtcatgttgcaagattttgtgtgactgtttattcctctggtgaattgatattccatatttaaaaatgaaaatgcaaggtattgtattgatgtggatagctttagaaaaattagattaatttctgttaagatttatatgggttgagatactgaaattagttttaataaaattttattttgtataactttggaattcttattaacagaattaaactacatttttacatgaaataaatgactccagaagtaaaaatctagacatatgaaaaaacg

SEQ ID NO: 2356 - DNA, 777 bp, Homo sapiens
cggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaaaaaaatgactatcaaaaaagaaaaaccttacatta

SEQ ID NO: 2357 - DNA, 1069 bp, Homo sapiens
gggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttaggtacaaaatgatgtgtgttaagtgcctacagatccatattgtatacacagaatgttttttactctgattgttgccctgtagaaacttaaggtataaggttgacctgcttcaagaacgttagggaatcacatatattgttgatggctaattgttatataaatggtaatacataaaattagtccccagtgcttgcagaatatagttcacagttaatagactgatattcagggtcttcgcactccatctttcttttcctgtcttctctttgactctttcctaatgtcagtcttccctaactttacccaggatggttaattcactttcccatggatgc

SEQ ID NO: 2358 - DNA, 1715 bp, Homo sapiens
tagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaat

SEQ ID NO: 2359 - DNA, 1572 bp, Homo sapiens
aggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 2360 - DNA, 1719 bp, Homo sapiens
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 2361 - DNA, 1234 bp, Homo sapiens
gtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggt

SEQ ID NO: 2362 - DNA, 2422 bp, Homo sapiens
attagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattcagataaattgagctcatatccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctgtgatctggaggagactccagtgagctggaaggatgacactgagagaacaaatcgattggtcctcattggtaagtctcaaaggattcacagttttgaaacaaagtgaaaaatatatttgaaagggatatcatgtgccacttaaacagattaaccattcaggtcctcttttaaaactaaataagcttgtggtcaatgtttcatctttgtcacgttacaatgttcgtaaaagcttgttaggacttttgttcttcttcaattttagaaaagtggttaatccaaggaccaatgtgactttgatgtactgacctggaaagttaaagatggaatcactcaattactattctttttgtaaatttttaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 2363 - DNA, 646 bp, Homo sapiens
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtaagtcatcat

SEQ ID NO: 2364 - DNA, 1184 bp, Homo sapiens
gtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgttat

SEQ ID NO: 2365 - DNA, 1126 bp, Homo sapiens
gtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgtta

SEQ ID NO: 2366 - DNA, 449 bp, Homo sapiens
ggaagaagtaaggaaaagagcaatacggatgtttaaaaatgagaagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattgg

SEQ ID NO: 2367 - DNA, 3326 bp, Homo sapiens
ttttaaaatgctggtaatggtcttttttttcttttttttttttttcttggcgattttaatgctttggaaaagatctcatgcttttatctccaaaggaggaaattaatttgatgccatggaaattagttttctagtcgtatgccttgaatgagtgaagaatttctttttcatggtggtactaaatttggggaaagctatagaaactttcatctggaagcttacacttttcctcttttttgaaaatttggtgagagacttggatattttattattttctgtaaaagagtgtaatttgttgtacaggtctaatattgatccttttttggaagtatggaaagaatctgagtataaagcagaattacctctggatggcatgtattctcaaggacactgtcatagtgaaacagtttatttagaagcttgtgtttccaaactgttgaatttgatattcacaaaattggcatgtgtaaactttattaaactttaagctatttcctaagatgaagatgacaaacttggagggaaacttcattcatttggtttatttttatttttatttttatttatctttttgagacagaatctcactctggtttgagacagaatctcactgtgtcccccaagttggagtgcggtggtgcgatctcggctcactgaaaccactgcctcctgggttcaagcgattctcctgcttcaccctccgagtagctgggattacaggtgtgcaccaccacacccagctaatttttgtatttttagtagagacggtttcgccacattggctaggttggtgtcaaactcctggcctcaaagtgatccgcccaccttggcctcccaaagtggagcccccgtgccccttgtttgtgacctgtcaatataaatatgctcagtagcggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagtattcgtaatctaacacagtattgttgccacgagtacgagtatgtgatagactgttgagaataaagaaagcaggcacagttggtcagtcctaagataaaggagatgttttttcttatatgtttgtgcattaaagaaaaaaaaatcttgaatctgaccaatgatgttttttttccttgtaagaaaatttaacaaatgtttggcaagcttctggaatctaaatttgaaattatacatttgtcattttctttaaatatttcttcaccttagctttgattatgagaaatcactgtcctctgctgttctttttttttttttttcttttgaggcggagtctcactctgtgccaggctggagtgcagtggtgcaatctcggctcactgcaacctccacttcctgggttcaaatgattctcctgccgcagcctcccgagtagctgggactacaggtgcatgccaccacacccagctaatttttgtatttttggtagagacagggtttcaccacgttgtccatggccaggatggtcttgatcttgaccttgtgatccgcccgcctcggcctcccaaagtgctgggattgcaggcatgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcatgtgaagatcagggtcctagagtaacctaatattttgtacattggttatttgactcctcatttttatattaaatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattggaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacac

SEQ ID NO: 2368 - DNA, 3377 bp, Homo sapiens
cacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgta

SEQ ID NO: 2369 - DNA, 2664 bp, Homo sapiens
gttgcgcgcgagccacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaagccgatggccagcaccaggagaggagtcaggccgcgactgtgcaggagatga

SEQ ID NO: 2370 - DNA, 487 bp, Homo sapiens
gctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcaggccgcgactgtgcaggagatgactttcccagctttgctggcttcagaagcctttgtacataa

SEQ ID NO: 2371 - DNA, 5638 bp, Homo sapiens
tgttgcgcgcgagccacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagcctcctgggcacctgcagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgtagacacgtttatttatctaggaaactaagtctaactcattgtagggattttatactcaactatacagagtatccaccaaagtcctaatctaaagtcctgctccctgtcactttttaaaagccagggtagcagtaacatgacaaacggctgctgtggcttcctcttgagagaggacagggaaagcctttcctcttcggctggttatgtggggaacttccttagtttttttccacaagaaattctcctttggctttgtttttctgaatggatggagactatgaaggggtttgtagttgtaagagatttaatattcaaaactgaaatattctgcatttcttagaaataccccatcttcccccaccccctttttgaattattaattcaagatcaacaaagcattcctcaagatcacttttaaaaaaggttagaagtgaagcaaatacattcagcttactgatcactatagtattgcataagcacagctcaagaactgagctttgtatgtgtccttttgggggataacagggctggaccatgcttccctgcccttaaacgcagagcttttagtgggtcacagagcgggaactacacacaagtgacttttttccccatgagccctctggccgattttttttttttttttttttttgagacagagtagctctctgccagccaggctggagtgcagtggcatgatctcagctcgctgcaacccccacctcccaggttcaagcgattctcctgtgtcagtctcctgagtagctgggattacaggcacccaccactatgcccagctaatttttttatttttagtagagacggtgtttcaccatgttggtcaggctggtctcgaactcctgacctcatgatccacccacctcagcctcccaaagtgctgggattacaggtgtgagccaccgcacccggctggccaatcttatcagaagtgagctaccaaaacttccacagatgtgagatttaacacttaattgcagtcacgtgtatgcaacacagcaataatctagaatgaaaaggagggtgattagccttcataagatgacctatagagcaaagaaaggtgactggaagggttcctaacccaacctactccccttagggtgtgtatccaacccagtgcttcctaagagggttacggaccactgtggttatcctctaaagttccagccagctctaggagtttctaaattcaggcctctgttggaaatggcctatttcgatagatagaaagttttctatagctctaaaggtttctcctttgcaacccattcaatttcagtctgctgctttgctctttcaaaacagaacctccaggctgacgaggcaagacaaagcctcccaccagacttggagattgaagttcttaaaaggcctttgttgtagccaaaggcatgcatgcgtcactggtagtaggaggagcctgtcccagcttcatcttgtcctgagatttatccacatacaggaaacaggcgggacacagtggctcacgcctgtaatcccaccactttggaaagctgaggcaggtggatcacctgaggtcaggaattcaagaccagcctggccaacatggtgaaaccccgtctccactaaaaacaaaaacaattagctgggcatggtggccggcgcctgtaatcccagctactagggaggctgagacacacgaatcccttgagcccaggaagcagaggttgcagtgagcctcgattgtaccactgcactccagcctgggcgacagagcaagactctgtctcaaaacaaacacaaatacagtatccaaacattggagattagtgactcacctgcagttgggagccagctacaacccaaatcattttaaaattttcaattctttgatctcatgcaatgcacactttcttctgaattagcaaactgaataaactacagaaattttttagaa

SEQ ID NO: 2372 - DNA, 2521 bp, Homo sapiens
gaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattt

SEQ ID NO: 2373 - DNA, 2658 bp, Homo sapiens
gttgcgcgcgagccacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagcctcctgggcacctgcagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggagatggagaggttcagaaggtctgagaaatctcacagagggacccaggagaaggcagcctccttgtttccatga

SEQ ID NO: 2374 - DNA, 2318 bp, Homo sapiens
aaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtga

SEQ ID NO: 2375 - DNA, 1809 bp, Homo sapiens
tacaatatcacctttcttatagattcgcatatacatggccaaaggaacaactccatgttttctaaaaggcctagagaacatacatcagctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtctggtttaatattcaacaaaataatacaccaatggctgtattttttgactattcaaaggaaagtttctggaagcagttgcttccaaaaaacgttcaaggaacaaaaatacaaagcatacaggtcacgggatttcccatccagatgccatacattgatgtacagtcaattattgatgctgtttatcaaactggaattcactctgctgaatttccccagacagaatttgctttagctgtatacattcacccatacccaaacaacatattatctgtgtgggtctatttggcttccttagttcaacatcaatgaaaaggaagcagagcaaagtaaaagattgtactatagtcctctagtaccaacaaaaacttttctggtaccttgagattttgctgtttattctcaagtccagctaagtgctgggcccaatttttgattcacttacagagctgggcactatggagactcgcacccctgagtgagtctttgaggaggagtctagatgagcttctcaccagagacctctccaggaaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatgttgggctga

SEQ ID NO: 2376 - DNA, 2467 bp, Homo sapiens
ggaaatggaactgaagaactctgtcttttgacatcaggaaaacttagctattctctatcatggagcttagatgaaaatggtcttcctctgatacctatgccacaatcattaagatcttcttactgcagtatgttaaggaatgtagatgcaagaagtgttcctggaattccatggctcatgaatgaacagaagctttttgaatgggcaaatgaagtcagaattgatccaaataatccagaatattctgatttaatggaatctgttacgtacatgagacttaaggggcaggatattccaaagtattttcgtcttgaacagttgcaagatgaatttaacttcgtttctgaagaggaaatggcaaagagtaaacgtttccagctattgcaacttagaaatgcaggtcaattagataatttccttctacagcaaatgcccctccatgatacagagattccagatttagtcttccagccaggtgcagtgactcatgcctgtaatcttggcactctggggagctgaggcagaaggatagtttgagtccaggagtttgagaccaacctgggcaaaatagagtatgaaagtcagaaagagaaggaggtatccgtttcagatgtaaattctattacagcacaaaggattaattctgccaattttctgaaaaaggtgagaaggttgataatgaagagaattgttaaaattagcaaatgtaacttgtcagatattgtgaatgattatgaagaaattgtatctacaagccaattgacagatgcagtttgtaagtttgttgaaccacggagaaagttaaaacctcagaggaaagaaaggaaaaaagtcacagcgcaggcgatctctgacggagatattaagattcttgtccgaatagtgagggcctataatattcctaccagaaaaacaacaattaatggcttctgctgccaactgccctattccatgccactgactctctcagtactggaagcagaaaggtggagaaaatgccccaggaaagctgcgaagcaaatgtggaatgatccttggatatgcctacttgtttgaaatcatctatatcttgcctcagacatagagaaacaatcaaatcagtagcctcagatgagaccttacatgaggatactgtacatccattcgtggaagtttctttccagcacactgtatacaaaaccaatacagcaagtggatctcatccatgctggaatgaagaaattaaagtagattttgtctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgaggatcgaaaggactctgaagagtaaagtgatggaatggcgacctaaacacccaacacattggaatcgacagtgtacttttattttgcgacaaatccttcctaagctggaatttggcataggaagctttgtttcatctgaaggagataatgaatttgaaagaatactacaattttattgggtcacgggatttcccatccagatgccatacattgatgtacagtcaattattgatgctgtttatcaaactggaattcactctgctgaatttccccagacagaatttgctttagctgtatacattcacccatacccaaacaacatattatctgtgtgggtctatttggcttccttagttcaacatcaatgaaaaggaagcagagcaaagtaaaagattgtactatagtcctctagtaccaacaaaaacttttctggtaccttgagattttgctgtttattctcaagtccagctaagtgctgggcccaatttttgattcacttacagagctgggcactatggagactcgcacccctgagtgagtctttgaggaggagtctagatgagcttctcaccagagacctctccaggaaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatg

SEQ ID NO: 2377 - DNA, 2113 bp, Homo sapiens
attcctttttaaacaatatccattctcttgatgtctacaatatcacctttcttatagattcgcatatacatggccaaaggaacaactccatgttttctaaaaggcctagagaacatacatcagaagttttaaactgtaccagtcctttcctttatgctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtctggtttaatattcaacaaaataatacaccaatggctgtattttttgactattcaaaggaaagtttctggaagcagttgcttccaaaaaacgttcaaggaacaaaaatacaaagcatacagcctgaagaaataatttattttgaaactgataaaagcatggtagaagatctaaggaataggatcgaaaggactctgaagagtaaagtgatggaatggcgacctaaacacccaacacattggaatcgacagtgtacttttattttgcgacaaatccttcctaagctggaatttggcataggaagctttgtttcatctgaaggagataatgaatttgaaagaatactacaattttattgggtcacgggatttcccatccagatgccatacattgatgtacagtcaattattgatgctgtttatcaaactggaattcactctgctgaatttccccagacagaatttgctttagctgtatacattcacccatacccaaacaacatattatctgtgtgggtctatttggcttccttagttcaacatcaatgaaaaggaagcagagcaaagtaaaagattgtactatagtcctctagtaccaacaaaaacttttctggtaccttgagattttgctgtttattctcaagtccagctaagtgctgggcccaatttttgattcacttacagagctgggcactatggagactcgcacccctgagtgagtctttgaggaggagtctagatgagcttctcaccagagacctctccaggaaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatgttgggctg

SEQ ID NO: 2378 - DNA, 2463 bp, Homo sapiens
ccctccctcggcccctccggcggcggtcgcagctgcacggtgcccgctctaccccgccgcagcggctgggacgtacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgccggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttcttggggcatctgaaagtatggcagatgtgggcgggggttgtgggggacggcatcggcctgcacctgacgctgaaccagagctcaggaatgtcaagtaacttaataaatgagtgaatgtgaagaa

SEQ ID NO: 2379 - DNA, 2644 bp, Homo sapiens
agaacttggcaggatgaagacaaagtgtgtgaaaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtc

SEQ ID NO: 2380 - DNA, 1392 bp, Homo sapiens
aggactccagaactgtacggatgagaaaaggatgcaggaaattctgttgtttacacatgtggctgcaactgagacactggagcagcccagcaagcccagagggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagatctaagtttcaaatcacttaaaattgttaatacagatagattgaatgcgcacagctttggaaaaagaaatagagagactggagtcggctttgtctctgtggaagtggaatttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggatgtaaaataa

SEQ ID NO: 2381 - DNA, 2666 bp, Homo sapiens
gttgtttacacatgtggctgcaactgagacactggagcagcccagcaagcccagagggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtc

SEQ ID NO: 2382 - DNA, 849 bp, Homo sapiens
gctaggcaaccacagctgcgggcgtggtctgcgcggggttgccctcctgttctggtttatcaggggatccccaaagaaagcaaggggaccaaggccgggactgctggggtgaaggtccgggaggctgagcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagc

SEQ ID NO: 2383 - DNA, 859 bp, Homo sapiens
atcaggggatccccaaagaaagcaaggggaccaaggccgggactgctggggtgaaggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttggg

SEQ ID NO: 2384 - DNA, 3397 bp, Homo sapiens
atcaggggatccccaaagaaagcaaggggaccaaggccgggactgctggggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 2385 - DNA, 1373 bp, Homo sapiens
gggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagttaactgcaaaggagggcatgtgataactccaggaagcccagagccggtgattttggtggcctgtgttccccttgtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaagacctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactga

SEQ ID NO: 2386 - DNA, 2048 bp, Homo sapiens
ttaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaagacctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacacttttgtaaatccaaatatcttaaacactttaggtaaaggacagtagggaaggcagctactcatactgattagtttaatacaaattcctggatgttttcccttggaaagagggtatagaaggaaactagttgatagtatgttcattcattcaaactcggttacctactgtttgtgccaggcattgtgctaagcactaaggatacaggagtcaactagattgacagggtcactgccttcatggggctagtggagagggcccaaagacgaaactgttagaaaggcaaagtgtagtgtcctatgagcagggctggctaagcctctttaagctgaatggaaggttaattacacaaagaataggtaaggaacagttcaggttctgcagcaggaaataaagcatatactgaaaaactggagtatatatatgagtggagacggttagcatatgaaattggagacaggtgggggactgacagtgcagagtcttacagggaatgtgaggatttaatttttttaaaaattattttagagacaggatcttgctctgctgcccaggctggcgtgcagttgcacaatcccagctctggattttaaattttgtaataccagcagtgtcaagtcattgaaaaattttaatgcaggggccaggcacggtggctgacactgtaatcccagcactttgggaggccgaggtggacagattgcttgagcccaggagtttgagatcagcctgggcaacatggcaaaaccctgtatctactaaaaatacaaaaaattagctagg

SEQ ID NO: 2387 - DNA, 1824 bp, Homo sapiens
agacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaa

SEQ ID NO: 2388 - DNA, 2289 bp, Homo sapiens
gcgccccgcccccgcgccccgcgtcctcacgccctggtcccgccctcgcgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccagcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaa

SEQ ID NO: 2389 - DNA, 2566 bp, Homo sapiens
ggcaccttgcccctccctcgccccgcccctccccgcctgaatcccggcccccgcctcgcatttcggccccgccctgcaccccagtcccgcccctcccgcacccccgcacccctgcacccccgcatctcagccccgccctgcatcccgaccccgccctacatctcggccccgccctgcatcccggccaagcccgcagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatc

SEQ ID NO: 2390 - DNA, 2069 bp, Homo sapiens
gtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataa

SEQ ID NO: 2391 - DNA, 5249 bp, Homo sapiens
ccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgcgtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgacttttaaaaaaaa

SEQ ID NO: 2392 - DNA, 5102 bp, Homo sapiens
gcagccggagtgacgcgtggccgccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgcgtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgactttt

SEQ ID NO: 2393 - DNA, 3215 bp, Homo sapiens
cccagaactccctgtaggaattgccaaggggagaaggaaggaagggtgtttctacagagatgacagaatgtggctagagtaggctttctcaaccttggtactgttgactcttggggtgggataattctttgttgtgggggcagtcctgtgtgtcgtaggatgccaagcagtgtccatggcttctactcactggataccagtagccccctcccttctccacaagtcatgacaatgacaaatgtctctaggctgagcatgctggctcatgcctgtaatcccagcactttgggaagctgaggaaggaggatcacttgagcccaggagttcaagaccagcctgagcaacacagtgagacctcatctctacaaaaataaaataaaattagccaggtgtgatggcgtgcacccataatcccagctactcgggaggctgaggtgggcggatcacttgagcctgcgaggtggaggctgcagtgagctgagattgtgccactgcgctagagcctgggggacagagcgagaccctgtctagaaaaaaataagtctccagacattgccaaatgtttttggaaggcagaatcacccgctgattgaaaactactgggcctttggagatggggagcatacgggcaagactggagagtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgctgcgggagcgcgcggagaaagaggaggcccagagcgagatggaggcgcaggtcctgcagcggcagatcttgcacctggagcagctgcaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagctgg

SEQ ID NO: 2394 - DNA, 2260 bp, Homo sapiens
aagcaagtggaggccgccagccgacttcctcgcactgtgcagctgctccagtgagggcgcagactgtactggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctggttctcagggctgctgggctcaagctctggcgtgcctgaagcatcagagccgaggcctggagaacaggagccaatcttccgcaagcgagagttcaataaggagatcaagtcattactgagccagctggagtccctcgacctgcctggctactgtccgctccgtgagccccatcgcacgctgaacttcctggctgaccaccgcctcttccctgccctgcaaagcgtggtcagccaggctgtggataagctccgtggcgcccactgccgcgacggccgtcctctgttccccaccagcttggagcccacctcagatctgccgcctctgggctctgagccagctaaacccaccaatggcgggcagccctatgcttccccccgccccacagtctccagccccaagatgcttcagagaaaacgcaaggacagaggaggctccccctccatgtctagtgcccaggtggccaccagattcaaactcaagagcccctgcagcagcagcaggttcacgaagaagaagccgctgccctccatctcgtcgaagtccagcatgtctcacttctccaaccgcctttatgaggagctcgccgacttcctgacccagcaggcagcctccttggtcatccgcaagtacgagttcgaaaaggacctcagtaagcagctgggcttcttctccttccccatcacccacgtgctcagggacctttccctgggcttaaagaaggtaaaaggctcccgcatccacctgtcctcggagacccaccggagctgcctgctgcgtaaactggaggagtccaaaagggcccggcaggcctcccggctcagcacctcccactgcagcacagagacaccctctgtgcagcaggaaccagccacccacactgcccaggaccaggccacagagccctgccgctccctctacaccaacttgccagccagccggcagctcagccctttggagcccaagctctacatgtctgcctgcaccggcatgggttccagtccccccaagtccaaggacatggacaatgagggccgtgataaagccgagattgaagatgaagatgaggatgagttcaaggatgaagaccaggatgaggacaaggatgaggatggagtctagagcctcccagagcctggagaggaggcctcggtcagccactccgtggacgtgggccacggtgacccaccatgaagtccccactagccactcgattccctgctctgtcagagttgctgcacatcacaccagcccctgccaagagcaggagtcaccacaggctgaatgcccacgaggagctctgctgagactctcaagggagccagtgaaagaaatagaaataaagcctgtgttgctgggacacaggtttgctgtcctga

SEQ ID NO: 2395 - DNA, 3985 bp, Homo sapiens
aacaaatcccggcatgcccccgagcggcctgaggtggagggttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttgga

SEQ ID NO: 2396 - DNA, 1137 bp, Homo sapiens
agctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgagataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactat

SEQ ID NO: 2397 - DNA, 1085 bp, Homo sapiens
gactccctccccacggccctccgcgggagcttcgcagcccagtttacagatgaagaaactgatccccggagacgttaacttgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaatt

SEQ ID NO: 2398 - DNA, 1035 bp, Homo sapiens
gacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgttgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatt

SEQ ID NO: 2399 - DNA, 875 bp, Homo sapiens
gcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggc

SEQ ID NO: 2400 - DNA, 1097 bp, Homo sapiens
ggcttccaaagctacaacctgccagcctatgctccatacctgccctgcgaggtctgaattccacttgctgctctttcactgatcagcgttggataaatcgagccttagcttttttttttttcttttttttttttgctggctccccacccactaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcagaaa

SEQ ID NO: 2401 - DNA, 412 bp, Homo sapiens
cctgccagcctatgctccatacctgccctgcgaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcag

SEQ ID NO: 2402 - DNA, 875 bp, Homo sapiens; identical to SEQ ID NO: 2399

SEQ ID NO: 2403 - DNA, 3973 bp, Homo sapiens
ggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 2404 - DNA, 3593 bp, Homo sapiens
atctgccactgctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaaggactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 2405 - DNA, 4023 bp, Homo sapiens
atctgccactgctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 2406 - DNA, 2342 bp, Homo sapiens
agagaaacttccgcaatgttctgggctgcgaacgaaaaccaccacagcgtcagaaaggagcgggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccaggcgaggcagagactgcaaggaagtcataatcagtgcctaaatagacaggatgttccaaagaccacacccagtcttccccaaggcaccaaatcaaggattaatccaaagtaacttctaaaataacactgattaaataagaactggagcaagtactcttaagtgctacattaacctggttagaaaggctgttggattccagattgctattgtaaaatctccatcatgatgtgttggagtgaaggattagatggttttatccaacagtcctactagatatttggtaaccagcttcccttaactagctttttctttaaatactcgttaataagctattccacaaacctccagttaacctaacacatgaccctaacctagccatttaccatacatcaaactagctaaaggaaaccaacctaaggaagtgaaaacagttgtgatttatttcatctagctaaattgtatttctttatagagaaagtacctttaaggatagcattccaaatagactttgaatagcgttctgccagtttatcctcattccttttgaccaacttagcagacaaaagcagtttttacaagctctttgtgagtttgtgccagtgaccaggtagctccttctagttttctcatgagtgaaaaagcattctgataacagcaagtccagtaagtgctaggcagagtgacctttcatctgatgctaagcccctacaagtttgagaaggtaagaaaagatgaaggagacatatattaggtcagctcttacttttgaaaatgttttatttgaagaaacacctgtagcattgaggtgactgaatgcctccacttatttcaggaaaacgtatccaaaaaaagttgaaatatttggacaactttttttttaagtgccatcgatttccctagcagcattctaaaagatagcaagtaaaatgatgtttgttatcctaaatgctttagttttaggtcatttattaattttcttacaggtgcactttctagtacatgaagtatcctttgtaattaatgtgtgccatatgtttattcccatttagtataactataaattatattttaaattatatatttttaggatagttatattttttttgggttctacgacattgaagttggactagtgatttatttgaatgctgaatcctagtataggggaatataatcttatattttaacaggggtcctctatgggaaaataggatgaactttgtttcccagaaattgttaagtgatgaaaaacttcaaaataattttcctgcattttctgctttatttacatgtaaagtgaattccctgaaaattggatttaaaaagcattctccttcaatgtgcctttaccttgtagctttaacaacttttctgttaaatatgtagttttttattaaacaatgttattaaataaaaacatttatccactgatttt

SEQ ID NO: 2407 - DNA, 1472 bp, Homo sapiens
ggcgaggaagtgggggcgctgagcaagcgagaggaaggctgaagggagctaggaaaagggcgctgatctctgcagcctgggagggcttttgtctcccggaggaaggccagaagagatggggtcccgagggcagggctcacacagcaagaaaacgaggagcatgcctgtcattttgagcccacagagaacggggagcggagccactggaggaccggctgctcgggcttattcggtagccgaggcggttaaacagttcagggctggaccagccgggactggagcagggtgcagtctccagggttgctgggcagcaccgagaccctttgagcaccgaacgaataaactacgggagctttccacacttgcacattgttcccgcgagttgcagacgcaggttcctgatgctagcgctcattccttggcagtcaccctcagtgaactacacagttgccgtgaccttcaggatgaatgcttggattccaggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccaggcgaggcagagactgcaaggaagtcataatcagtgcctaaatagacaggatgttccaaagaccacacccagtcttccccaaggcaccaaatcaaggattaatccaaagtaacttctaaaataacactgattaaataagaactgga

SEQ ID NO: 2408 - DNA, 986 bp, Homo sapiens
ggaggcgcgaccgggccggcgctggggtaagaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggc

SEQ ID NO: 2409 - DNA, 1055 bp, Homo sapiens
gagacggactcttgctatgttgcccaggctggtcttgaactcctggcctcaagcaatcctcctgcctcagcctcccaaagcacggggattacaaaccctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggcacttgaa

SEQ ID NO: 2410 - DNA, 1456 bp, Homo sapiens
atcgcgcctgcgcaccatgccacgcccggagcgggtactgagtgggggcgccgcgcctgcgcaaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaagtaattttctgtctgtttcatcactccctaaatactttctcctcaaattatttttctctgtcaccagattacattaagaatttgtcagataatgtgtagaactgcataacaggtaataggaagtagtaatattatattatcaagggtttatattttaaagatctctctcactccataaaggggaaataccaagtgtttct

SEQ ID NO: 2411 - DNA, 576 bp, Homo sapiens
tttctccactttccccaaccagattgtgagtcgctttcatcttaagttcttgttttttttttcctttttctttttctttttttttgggggggacggagtctcgttctgtcaccaggctggagtgcagtggcgcgacctcgactcactgcaacctccacctcccaggttcaagcgattctcctgcctcagcctcccgagtagctgggactacaggtgcccgccaccatgcccggctctggtctagtttttttcttctttgaatcccgtagggcctcagtgctgtgcagcaagcacatagttaaaactgaagaaaaatttcttgaataaaagtagttaacgtttttattctttacttcaaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggat

SEQ ID NO: 2412 - DNA, 4544 bp, Homo sapiens
atcctcccagaaacccagccggcttcacctctcaccaacagtggctgcgggactttccagcacctagcctgggcattcccacagcccagagggagctcgtcccagacaaccaagaggaaaagaagggaaacaagaaagagatggagacccatcattgtggccaacgaccccacgaagagggaatagcggtccacgcacgggacccagcctccgatcaagcccagcaggcgccgggtgcgcctgtgctgggaggcagagcccacgcccacccggaaccgcgccggccagcgaggtccgtgcgcagccccggctgccgcctgcgcttctccctccacacctcaccgttagcagagggagccggctccggcctcagccagccccagagacaggcccccacagcacagcggcgggctgaagggctcctcgagcgtggccagagcagacgccgaggctaaggaggtgccgagagacagcgagggctgctagcacattgtcacctctcaatactggaactcagaataagaggtctccactgttctgagttatgggagaaagatgggtgtatggtagacagaatagtgcctccccacaacaaagatgtcaacatgttactgtgtgtgttaaaagggactttgtaggtgtgagtaagttgaagatcttgagaagaaaagattatcctgggttttttgggtggggccaatgtcataaaaaggtccagataagaaagaggcagaagagtcagggtcagaggaggagccatcatgataggagcagagaagcagagtcaggagagttgatgctacactgctaactttgaagatgaagaagccacgagctatggaatggagacagcctctgaaaggcaaggagatggatttcctttagagcttccaggaaggagtgcaggcctgctaacagatacgttttagcccagtgagactaatttttagacttctgacttccaggaccgtaagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgccaacccattgtcagctatatctctcatattctaccctttggttaaacccaagaggagtttagaatactctaatactcattcagtatagaataactgagcacctagtatgtgcctggcacagagtatgcaacagtgactaaatagtatacggtctctgccctgctagaacttacagtgtagtgggggagatagaattgcaaacaaaaagtatctgagacagacctcagtcaatatagaagtttattttgccaaggttaaggatacacacccagaagacaggtctgtgcctttctccaaagatgattttgaggccttcaacatttagtggggaaagggtgctaatggggaaagaggtgtgggtacataggaggcaaacagttgcatttttttgagtctgatcagcttttctcatgagagaaggggtagaggaactgtcacttatgcattcacctagctcagtggatctgcacttttacagaaggtaaaataaacatagggcagaggaagcaatcagatatgcatttgtctcgggggagcagagggatggctttgagttctgttctttgtcctgtacctattaagagaagctatcaatatactttgtcaggataaaattcaacagaactgttttagactaaagattttagggaccacaaggaatttcccagtgggcaaattgtgagggaggtatttagcttttaaaaaaatctttgtagctatctcatttagaaataaaatgggaggcagattgcctgatgcagctcct

SEQ ID NO: 2413 - DNA, 3269 bp, Homo sapiens
tgacttccaggaccgtaagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgcca

SEQ ID NO: 2414 - DNA, 566 bp, Homo sapiens
agatggctcaggagtggagcttttgtggcaggtgggtagaggctgctggagggggctttcatgatcatctgctttgagggataaacattgcttgtcccctcctccaactaaggaagttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatag

SEQ ID NO: 2415 - DNA, 3529 bp, Homo sapiens
acacatactttgatgccaactacagcaagttgcaagaccatttctctgctgaaactcctttattctgttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgaattattgtctgcagagctggatcccttttttttttcttcaaaagcaaataactctgctaaagatgaaaaaataaaatcaaaagactttctgaagacacaagactctggtctgttgtaattgtttttctttgttgagaaaataatcagtttccagagtataacacatgtcgaacaaaatagaacatttgtaaagaggttagagtatcaaagtggtgcccctttgagaagaaaaagttttagagtgttttcatgtggaatggtgggttgcatacgtaatttcaaattgtaatttaaaacaacaaattgttcatgatgtgcgagaattgtaggttattaaaagccttgttaaattgtttttcttgaaaattgagagaacaggaacagaagccaaaatatggacggcacctttctctagcccaaactcagcctctaattgcctgatctta

SEQ ID NO: 2416 - DNA, 582 bp, Homo sapiens
cacacatactttgatgccaactacagcaagttgcaagaccatttctctgctgaaactcctttattctgttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaat

SEQ ID NO: 2417 - DNA, 558 bp, Homo sapiens
agatggctcaggagtggagcttttgtggcagttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattc

SEQ ID NO: 2418 - DNA, 4025 bp, Homo sapiens
atgtcatttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgccaacccattgtcagctatatctctcatattctaccctttggttaaacccaagaggagtttagaatactctaatactcattcagtatagaataactgagcacctagtatgtgcctggcacagagtatgcaacagtgactaaatagtatacggtctctgccctgctagaacttacagtgtagtgggggagatagaattgcaaacaaaaagtatctgagacagacctcagtcaatatagaagtttattttgccaaggttaaggatacacacccagaagacaggtctgtgcctttctccaaagatgattttgaggccttcaacatttagtggggaaagggtgctaatggggaaagaggtgtgggtacataggaggcaaacagttgcatttttttgagtctgatcagcttttctcatgagagaaggggtagaggaactgtcacttatgcattcacctagctcagtggatctgcacttttacagaaggtaaaataaacatagggcagaggaagcaatcagatatgcatttgtctcgggggagcagagggatggctttgagttctgttctttgtcctgtacctattaagagaagctatcaatatactttgtcaggataaaattcaacagaactgttttagactaaagattttagggaccacaaggaatttcccagtgggcaaattgtgagggaggtatttagcttttaaaaaaatctttgtagctatctcatttagaaataaaatgggaggcagattgcctgatgcagctcct

SEQ ID NO: 2419 - DNA, 2943 bp, Homo sapiens
agggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggttcaagagcttgagaagcaattgggccaggcccggagccagtctgcgggaacagccagtgatgagttgtctgtctatccagacccaaggaagctgtcggcacaggagaaaaacctgctgaggatccgcagcctggaaagggaaaaacaggaaggcttggagaaacttgccagtgaacgggatgtcctccagagagagcttgaagagctaaaaaagaagttcgagggcatgaggtctcggaacaagctgctgtcaagtgagatgaagaccctcaagagtcagatgggaaccctggtggagaagggccggcatgatgacgagctcatcgacgccctcatggaccagctgaagcagctacaggagatcctaggcagcctgagtctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcactatcttcggaataaaggagtgggtgaggggtccagtggccgcgaggtcagccctgcctatacccagttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctaggttctcggactccccagaacaaaaaggctggcaggcacaagtgtcagagatcaaggccctctggcaggctgccgaggtggagcgtgaccggctcaccgagtttgtcactgtcctgcagaaacgggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaagagctgacaaccaggctggccatccaggtggaggagaatgaaatgctaaaggctgccctgggcagtgccctgcggggaaaggaggaggacttccggatgtaccatgagatcctgggccaggtgaaaagtgtcttcctgcaggccctgcggcagcagaagacaggcaagcaataggatgacagcccagtgtcggcctggccgggtgggcagcctcaggtcttgagaggataagactctgtctgaggactccatctgctccgggaagccagcccagggcagccagctcaaccacttctaccagaagaggctccttaaggatgaccaaaaccaatgtctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataatcactgcagctcccagtgagtgagcatctactgtggcaacctgaccccattcagtcctctaatgacccaggggtttgttgtcttatttgacagatgaagaaactgaggttcacagaaagaa

SEQ ID NO: 2420 - DNA, 1665 bp, Homo sapiens
agcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttcttc

SEQ ID NO: 2421 - DNA, 995 bp, Homo sapiens
atgcgcctcggagctggcttcaaccagcgaaggctgaacccgcttccagggtcctcgccgagctgggagttaggatccgagggggctaagagggataagaaaacttctctgggtgcccacgtggtactgagcgcccttgggagggctctggagaagaccatcgccttccaggggaaggaaactgaggtccagaaaagttatgactcgccccaaggggattgcctggcaggacgtgaaggggaagaggcccaccctggagtaaccctcactggagaatccagagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacaggtgagcgccacccacttacctgcctgggggccctggccctgagtctgcgctggggcccccaaagcccagccgagctctgatcgttgcagagcatgagaagaagcagaagct

SEQ ID NO: 2422 - DNA, 1193 bp, Homo sapiens
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacagtatgtagtgacttaattactattcatatatctctcctttagattttaaatttatatttcctttatcttggtacatacctatttgaaaatgctactaaaataaaaataaatctttgccaaaaa

SEQ ID NO: 2423 - DNA, 3613 bp, Homo sapiens
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagccta

SEQ ID NO: 2424 - DNA, 2134 bp, Homo sapiens
cttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttgacggagtctcactctgttgcctaggctggagtacagtggcgcatctccactcactgcaagctccgcctcccgggttcaagccattctcctgcctcagcctcccgcgtagctgggactacaggcgcccgccaccacgcccggctaattttttgtattttcttttttttagtagagacggggtttcaccgtgttag

SEQ ID NO: 2425 - DNA, 2485 bp, Homo sapiens
atggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaagcatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatgg

SEQ ID NO: 2426 - DNA, 3474 bp, Homo sapiens
gtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggtattgagctacacgtaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcc

SEQ ID NO: 2427 - DNA, 3614 bp, Homo sapiens
gtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaagttagagccctaacgtgatgttaactttggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcct

SEQ ID NO: 2428 - DNA, 2383 bp, Homo sapiens
gtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctaaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtaatactaatatacaagatggcgtttctagaatgtatgacactgaagtgactttttgtaaaaatatattaggaaaattatttcttaaaattatgtgattatttggaataaaattggtgcttatgtgagaa

SEQ ID NO: 2429 - DNA, 2250 bp, Homo sapiens
ggccgcgtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtaatactaatatacaagatggcgtttctagaatgtatgacactgaagtgactttttgtaaaaatatattaggaaaattatttcttaaaattatgtgattatttggaataaaattggtgcttatgtgagaa

SEQ ID NO: 2430 - DNA, 1699 bp, Homo sapiens
aagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcccggcgcgatctggccagttcttggggagcgcggacctgggactgcagagaggcgttttgaagagtgctgcgcgcacctgcctctcggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttacc

SEQ ID NO: 2431 - DNA, 441 bp, Homo sapiens
ggaagataggaagagagaaggaaaataggaaaggaaaaagaaaagaggaaaagaagagagaggtacttttttttttaaaggcagtgagggagggagagaagaataaatctcacagcagctggtgtcctagttcatttgggtctgagaaaattatttttaggcaaacaaggaagacaggattccgccgcccgattctccagggcgggaagaataggatgtcttgtaaaaaataagactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcg

SEQ ID NO: 2432 - DNA, 3786 bp, Homo sapiens
agatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtgggtagcctataatgacaagccataaatggaaacaaattcaatcacagagaaaaatcattctgtgagcactaactgaaaggtttagggctagctgattaatattctatgacactgcaactctgcatgattcaatctcacatcagacccctctcattttagtagcagcatagttaatacctttaagaaaaataaaaggtaaccatataaagtactaataatttaacaaatttccaaagcactgtaggttggttgtgcttgttttcttctgtgtttaacattccacatttctaaagattgtgggttgaaattattttttattgtctatttccatataagcatggcatctgcttgctttaactacctttatgcaattgaaaatataagaatttgtttttatttccctttactctcatttacctctttcatctttttcctctttccaacagagtcacacgtgtcatctttgtaacattttgttttactaggatttctttttacaaattttttcaatgtgagaggtggaatataaatatttctgtcacagttcctccaggtgacaggcaataaactcatttttgaaaggtagtataataactgagctgtaaacaatatgatttcactctggagacatcattattttttagcctctttttttcagtaaaagcaaactgtagaatactggttttggatcacctactattggtaacaaaagcagttctttctcaatatgtgggttacttttaaacatttagaaaattctcatccttaagtaaatttatttcaggacaaagttacaaatctgcaaaagccagtttatacttataaactaagattaagtaaaatagcatttattgatcacaatgtttcagtagatattaaatgatcagtttcagttattgtgtgtgcccattgatggtacttgaaatatgaaccagttatctaaggaacttatgagaaaactttggtttctcaaattatttaaaaaactgcacttgtgctatattagtgcagtcacttttgctttttgttttattgtctttactgttgcatgttttttacaaatcaagagtgtcatatttatgaattttaaagatatttaattcattattaaatctcagttcactcc

SEQ ID NO: 2433 - DNA, 3795 bp, Homo sapiens
agatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtgggtagcctataatgacaagccataaatggaaacaaattcaatcacagagaaaaatcattctgtgagcactaactgaaaggtttagggctagctgattaatattctatgacactgcaactctgcatgattcaatctcacatcagacccctctcattttagtagcagcatagttaatacctttaagaaaaataaaaggtaaccatataaagtactaataatttaacaaatttccaaagcactgtaggttggttgtgcttgttttcttctgtgtttaacattccacatttctaaagattgtgggttgaaattattttttattgtctatttccatataagcatggcatctgcttgctttaactacctttatgcaattgaaaatataagaatttgtttttatttccctttactctcatttacctctttcatctttttcctctttccaacagagtcacacgtgtcatctttgtaacattttgttttactaggatttctttttacaaattttttcaatgtgagaggtggaatataaatatttctgtcacagttcctccaggtgacaggcaataaactcatttttgaaaggtagtataataactgagctgtaaacaatatgatttcactctggagacatcattattttttagcctctttttttcagtaaaagcaaactgtagaatactggttttggatcacctactattggtaacaaaagcagttctttctcaatatgtgggttacttttaaacatttagaaaattctcatccttaagtaaatttatttcaggacaaagttacaaatctgcaaaagccagtttatacttataaactaagattaagtaaaatagcatttattgatcacaatgtttcagtagatattaaatgatcagtttcagttattgtgtgtgcccattgatggtacttgaaatatgaaccagttatctaaggaacttatgagaaaactttggtttctcaaattatttaaaaaactgcacttgtgctatattagtgcagtcacttttgctttttgttttattgtctttactgttgcatgttttttacaaatcaagagtgtcatatttatgaattttaaagatatttaattcattattaaatctcagttcactccaaagaaaaa

SEQ ID NO: 2434 - DNA, 9127 bp, Homo sapiens
agtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaaggctttggaagatcgggtatgggaactcttgcaggaagcagacaagacagctgaagagaacaaggatcagagtcaggtctatgatgccatggccgagactctgggtgaagcatgggcagctctggtgtccatgcttgaaagaagaacagagctccttaggttgacttctgaattttttgaaaatgccttagagtttgctattaaaatagaccaagctgaagatttcctccagaatactcatgagtttgagagtgctgagtccttaaaatcacttcttcagcttcatgaacatcatactaaagaactcttggaacggtctttagcccttttaaacaaaagtcaacaactcactgacttcatagaaaaattcaagtgtgaaggacctaatgtgaatcctgagttgactcagggagctcatagcagctgtctgaaggttgaccgccttcttgaacttctacaagacaggagaagacaactagacaagtacttgaagcaacagtggcaagaattgagtcaagttctgcagatatgtcagtgggaccaacaagaaaaccaggttacttgttggtttcagaaaactataagaaatttacaggaacaaagtctaggttcatcactttcagacaatgaggatcgaattcataagcaagaggaactgataataaaagcaaaggaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggcatttgatgtacttggaagagttgaagcttaccttaagctccttaaatcagagggtttaagtctggctgttttggcagtgaggcatgaggaattacacagaaaaattaaagactgcacaactgatgctttgcaaaagggacaaaccttaatcagccaagtagactcctgcagctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtggaaatgtcaattcagaaaatcagtccagtactttctaatgcaatggatgttggttctacccgttctgaatcagagaagattttgaataaatatctggaactagatatccaagctaaggagacatcacatgaattagaagcagctgcaaaaaccatgatggagaaaaatgaatttgtatctgatgaaatggtatcactttcctctaaagctagatggctagcagaagaattaaacctatttggccaaagcattgactatagatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtacaagaagggccagaaattgtctgcagatgggcacttacaggttttacacaaggagacaaggcattcggtgttcattccaaaggtatgcaaggcagacgcaggcctctatgtggctcgggcccaaaactctagcggcgctctctcttccaatgtcatcctccacgtgacaggtaactgcaggctgccaatcacaagagtaaactggataaccctgtgtgtcgtctatgttagtgtgtccctaatgtactggctcctcacacaataactgtggtgttggcaccaatggacatcattctcatgtgcctaaagaaaagtgccgccgtttatcttcctgcacctcctgcaaagcatctcccaccaagtgtatctccagtctgatcaccatacttgtttggctaataccactgctaggtgaaataatcaaattttctggagcgtttaatatatttgagaagcttggtaaattatctgtagtggataagaacagatttttgtactctagaaacagatgttttcaacataatatgcagcaaaattattctatgcctattccctcctaatttaagggcgtgcagatgaaggctgacatcggcatagaaatgtgctaaatttcaaatatggttgttcaataatatatttttaattgtattttaaaacatccctttgtagggaatatcagtagaactattgaattgatgttgtatttttgcattagctgtcctttaattttgctttccatgtcttgatcttgttaccgaaatgcattctgtgtaatttcaacgtagactacgttcctgagtctgatgatgtcattgtaaataatcattcctcatgttgctctcacgggtttgacattggaggatagatgtgccatcaactttaaatagagtttccatcttttgtcagctctgcatgtcatacagcaagatggaacacaggttgcaagaaagaaccaacgttattcctgacattctattgatgtgttttgagcagcaatgtgtaaccaggtgtttctgcttctaatcttgattctgctgatgaccatttttatactttatggcaaagcctcattgcctcagtttcctgtctggaaaatgagttcatcatctacctcttgggcaattgagagttttcattttgtgtcttttaaacatctggaaaatggaaaacactgagggctaaggataatgatattgtttaatgtaatttgtcatcagaccggcctcctgctcactatttctttttttttagatgctgtttttttagaatattaaattaaaggagtgctgttaatatgtaatcttcaactagttccatggaggaaagtgatgttttatgaattagagcttaaattcctatctaatttctgaagactgcattcttttcaaagacttgaaattaaactcaggaggatacattttgtttgttctagggggaaacgtaatagaatggtatgagatgaattctatccttttacaataattattactataatattgaagtattctatgcctttctgaaacactttattcagaaaagatcattttttggcttccttttaaaaataagcttgaagtagggaagcatttgcttcttagattttaaatgtagtcttattatgctgaggaaaatctttagttgaaagaataattcattacagatttttgatgaagggaagaaattaattatgttgctggaagactgtctacaaataatcaaaatatttaaatgtaatgtattcaagttgttattaaaaagttactgaatgttatctgaagatgtgaaatgtgtagtcaagtaaaaagttggcgtatactttcttgggctgcatatccaatttaattaaaaaattaaatctcagtttccttctaaattttgatagaactatattaaaagcttgtatacacagcattctaggaaatttctcttaactatcttttttttgttttttttgttttttttttttttttttgagaaagagtcttgctctcttgcccagtgcagtggtgccatcttggctcactgcaacctccacctccgggttcaagcaattctcctgcttcagcctcctgagtagctaggattacaggcatgcctacctaatatttacatttttagtagaaaccaggtttcaccatgttggccaggctgggcctcagcctcccaaagtgccaggattacaggtatgagccaccatagccggcctcttgtatcctttttgtccaatttcaaataatgtgtgaatcttgcctaactgctgttgcccacgttgaagctaaagagtaaaaacctattcatgaacaaagaaggcaggtgagacccggtaacaaactgtctctcttcccactttctctttcttattaatttggcaggatctcccttcccattttgtcaacatggttgaatttgtgtgttggggttgttagggcatgggaattcctggtttgctttctctattgcatgcttgttcatgttaactctttggggagcagaatgagatacatatgcatccatggttatgatggaaaaaagcatgcaaaatccatttttagagagagagagaaagagaaaggtgggggtgggggagcacaaagatcagaagagtactatgctgatattcaagatatagtacagatagctttctgtgtacctatccatctacctattcatctgggctattgattgactcccacagcagtaaagaataattacgcagttattcttctggttatgttttaatttcaaaaagttaagtgtgattttcctttttgctgggatttctgtcttgagcaaataattattcttatgaaagtatcaattgcagttactggttaaaaatgtaagacctaggaaatttaagtgttgtttctattttaaggtatatacataatttataaccatttacttctagagaaaatcctgaatggttagtaatatcaaaacattttcaacaagaaaactaaaatgaaaagaaagtttaaaaattacatgtgttacagctcttttagaatttgtctagcaggttttctggtgaaaattaaactcaagattttcaccagaaaacgttttaaaacttctaaactcttaaacaaattataaatacttgatactttgaagaactgcaaaacaaaatgtttttaagttttcataaggcaaaatcattgagttttccagctttgattttccaataaaaggatgtataaatatttggtggtagtttttcacactcaattccaagagaaatttactgtaggaatctgtacatttgaatctctgaatattctatgatatttaaaatatttgaacaagatgcagaaaattttttagctatattaatcaataatggtaacctctatcactcataatcaagacacatacttaaaatagatgactacaagacccttctaactgctttgctcaaatttaaatttcctcaagtagttcatagaccctttacaacctggcctcccctctctggcctcggtttgatcccctcctattacccccaacccctagtaaagtgacatttaacttcagggttttaacatatcatgctcttctctccagccctttcttcctataactctcttactatcttcaccaccctatcttcatgtgacttaactcttgcttatgttccagttctgctgagacacaacttcccctgggaagcctcctgacccatcaagtccagagtagatggtcctgccatgtgcactgtcagcacctgcactgcccagccacgcccctgaatatacacaaaggaatcgcaggtttgagcatcagtctcctctggctaggctgtaagaaccttatcagcaggattcatgacagccctgttgtcattgtattgccagtacctaagacacagtcacactcagtaaactcttttgaattgaattgttgccaaaggtaaacaaagataaacctagcttgtttttctcccctttttagagggaggagaggggaaatgtaaaaagacaaagatgattctcccttcttatagacaggagtcaatccgaatcaggccctaacaatgaagcactcatgaaaatctctcacctcatctgcaaaacttgtgtgagaaccctccagaccctctgggctagaccctgattgaaaatttgaatttaaaaatagatgctggctccacggactaaaataatagtaaggaggaaagaggaaaggtccaggattgttgttcctggatcaatattgttccaacattttaaagtgttccaacattttaaaacatatgtacttaggcataaatcatcatccggtatgaggaactggatgcctccactctctatgactaaatccaaactgtcaaaaccagaatttatgtacttctttagaacactacgtaaatgatcaatatttaattgtagctggggctcagtagtctgggctgtgaacagatcttatttgaaaccagtatttcatacaaacttgtaaatataaagaaagccaaatccaagaacttaagagtatttgaattccaaatgaagaaaggaaagaatatcttattttgttctgctttatgtttgtctttattcatgaccatttcttactaaaaatcaccatctgaagcttttgaaactcctgttgtatgcacagcattttaagtgcagccatgaaataagttagttgaaacaaaataaaatatctccttccagta

SEQ ID NO: 2435 - DNA, 3406 bp, Homo sapiens
ctgcataaaatcctactcgaaacgttcagaccacaggtggacccaagaggggctgcctctgccctcctagacccccactggtcttgtcataccgctcacctagcttgatccgccccacagtctttggaatcggcgccatcgcatctacagtgacccggaaatgaaaggtagtctagtatttgataccagccaaagggcggggtgggacagagtgggcggccatgtttgttaggggcagaagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcagatcctgcgcctgtcgccctaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctcaaaaaaaaaaaaaaaaaaaatccaagattaggcagggcatggtggctcacacctataatcccagcactttgggaggctgaggcaggcggatcacctgaggtcgggagttccagaccagcctgaccaacatggagaaaccccgtctctactaaaaatacaaaattagccaggtgtggtggcgcatgcctgtaatcccagctactcaggaggctgaggcaggagaatcgcttgaacctaggaggcgaaggttgcggagagccgagattgtgccattgcactccagcctgggcaacaagggcaaaacttcgtctc

SEQ ID NO: 2436 - DNA, 2835 bp, Homo sapiens
aagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctc

SEQ ID NO: 2437 - DNA, 2806 bp, Homo sapiens
gcttggcgtggcagtgatcgcttggcttggcatttctggcttagcggtcctcctttcgcagattggaaaccgcgggctatcctgctgggaggttgtggccgaggcagtagctcgctactgatggcctcctggggtggagaaaagcggggaggggctggggggtctccgaagccggcagtctacgccacgaggaagacccctagtgttgggagccaggaggaccagtggtacttggactacccgggggaccagtggtccttgggcttctcctacagctggtggaagaacagcgtcggcagcgagagcaagcacggtgagggcgccttagaccagctccagcacgatgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagctgctccaagccaggctgaaggaggagaaggaggagtcgcctgtggtacggtggagcagatgacgtggctctgcagcttgcctcatgcagttggtggtggagatggagaccacagctcgactggagcggtaggagggcacccacgggggcctggagagtattgtcatctgcatgagcaaagggttcatcaccacatctttgcaagaggaaaaagaaaggggaagaatcatgtgtctaatgttgtaaggtaaacattcacaaccaaaaacaaggttttattaacttttgcctttaagaacctgcagtgtttagccctctttgattcctagtattattacctttggtatgaactcttttattaaactgatcactctagaggtttatgcattttgtatcatttttcaagccaacagaaatgtgtaatgcctataattctgacactttagttatttttaaggctatgagcatgtaagatactgttggaagaatatgtataaataccactaggtagcttattttgaagagatagtatctaaatttttgtccagagtagattggttgcagtttcttaggtgtgtttcttaatacgttgcctcaatgttttaaagcatgtagaaatttgaatacagtttaacttcatatagtcctttgtttatagatttaatatttctaaagactaaagacatcacagctccctttaagattcagtaatattaataaaattttagaaatatagggttagaatccaacaaattcagaggaaaattgttaaattctatagctgtagagcagaaatgaaacccaggttctaagctctaagggggccatgaggtaccatacaggtgcatcagtgactgggcatagattcagcaaaattacaggatggttaagagagtgagctgtggagccaaactctatgtaacatgaatttttaaactgcctggtgcctcagtttatccatctttacagtggggactgtagtaagtttttctttttctgctcagttgtctgtcttgttgccactgttccctagtctgtcttgttgccactcagtgcccacatgagaggatctacggtaatttctgacagcctgggactccttaaagaaaaacagaaggtgctacaaaacccattttaggagaaacctctgttgtcctcatggaaccccaagaacttcaggcagacaggtctctctcaaaatctaaggctctcctctgttttgttttgcgttatctgaccttttaggtttggttgggcatcagaaatcagtcggggagagagatctaaagaaagttgtggatatgaagatgtatttatggtaaaaaagttatgaaggaaagaaatgttatatgagagaggatcttgtatggcaaattcttgtcctaaagtagaatgactaattatgaaagagggaaatacaggaaaagtcagaaagttcatgtcatagatggtctgtggaagttgtgctagggttcataaaatgagaaagaaaaacttacaactgctagatcttctcctgtctagaagtgttgtgtatgtgttggatatgtaaaggagccctaattacttggcttagaagaaaaggacggctcttaaatattttgtcagaaaaatagaatctccaatgccttttatttcacatgacttcagtaatctttgggaaataaagacagtgttaaaatcattggtaaaaaaaatcatcaaaatttatccattttgtctaatttaagtcagaggttaaattttagaagtgctttaacgtcataaattgattgactttggaaaattgttctgtttacctggtttggagctgctcaacttctaggtaaggcctgggggacaggtggagttagccatgtctcctagctatgctggaaagagtcagactttacctgcagttctgtcttgtatcctatacactgcacctggtacgttattaaaacttcctgctgcttctaatctctgagttccactttaaatttttccatcacttgaatactatcctctgtactaaatttttccgcaattaaatacttagaatcatttttgcccacttgacccaagcattagtgatatatctttaaaatacttataatgtgtcacaatatatttagcaaatgtagcgaatggcatttttacttttgtcagcatttacatagcatttagcaatgctatctcaagtatttttagtcatttgaatgttacataatatgcttttcctttgtttctatgtaaataaataggagatattcaataaatagtatcaattaa

SEQ ID NO: 2438 - DNA, 3375 bp, Homo sapiens
ttaaaggatgcgaaaataagcagccacaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtagttatgagagaattccaacaagaatggaccgatctcctaaaacaacaacctacgtcagaggctacctcacgttgtcacattaatttagatgagacacaggattcaaagaagaaattgggtcaaatcagaagtgaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaaggttagctatcttttttccttcggcgttcagatttctgatagaattcttgtatgttatttggtaaaatagttacttaattgtcttgtgtatggtaagtaaaagtaataattacctgtgttaataaagagaggagacagaaattttaccgttatttttaagtctctggagctctcattgataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcgtcatctcaggttttctacctgtcatcatatgtgaatgattggtgtccaaacactaaccacccatggatgtttattatttaaaaggacccaaggtgaatacttttatatgttatataaacctgcaacacttgattaatctgttctttaagttaaaagttttgtgattttcttatatgagtacatctgtaattgctattgcacttaatagtgttttaatcccaattttagtaaaatgtgtctattgctatgcaatagcacagtggttttgaaatagttaaatcaaataaatatttgaatttttaaagt

SEQ ID NO: 2439 - DNA, 2196 bp, Homo sapiens
cttacccacgaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggtaagcctatagcagcgtttaacaggagacaattggtcaagcgtggtggctcacgcctgtaatccagcaatttgggaggccaaggcgggtgaatcacctgaggtcaggagttcaagaccagcctgaccaacatggataaaccccatctctactaaaaatacaaaattagccagatgtagtggtgcatgcctgtaatcccagttactcaggaggctgaggcaagagaatcatttgaacctgggaggcgggggttgtggtgagctgtgatcatgccattgcactcgagcctgggcaacaagagtaaaactccatttc

SEQ ID NO: 2440 - DNA, 5545 bp, Homo sapiens
cggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtagttatgagagaattccaacaagaatggaccgatctcctaaaacaacaacctacgtcagaggctacctcacgttgtcacattaatttagatgagacacaggattcaaagaagaaattgggtcaaatcagaagtgaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggat

SEQ ID NO: 2441 - DNA, 5828 bp, Homo sapiens
cggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcaggatccagccaaactggactgcacagaattccacagtgctcgtccttctcctccagctctttgcacttgcttctttgctctatctgccaacctttttttctcatccttcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgagg

SEQ ID NO: 2442 - DNA, 2815 bp, Homo sapiens
gcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaaggtaacaaagaagcatagagaattcagtcctagagtgcctctgcttggctgcatagagctatagttctgacttaaaaaaactttttctggtaaaatgtgctttgtgtttactcaccttttgcactgaacagaatactttttggcaggatatttgtgttcttcctttaaccaaagcaacatctagataacagagaattaggggaaagcatgattttctttaggaagtaggattatatttagaatatagggactaagtatgtttagggactaacataggattatatttaggataacttagtagagacctaaagattgctgactcaaacacaatgtggtttctttgctttatttttacagctctgaattcacagctgttagttataactatatgcactacaatttaaaagacaccttcccacacctgtaatctcagcactttaggaggccgaggtgggtggatcatgaggtcagtagttcgagaccagcctggccaatatggtgaaaccccatctctactaaaaatacaaaaaaaaaactagctgggcatggtggtgaacgcttgtagtcccagctactcaggaggctgaagcaggagaatcgctggaacccagaaggtggaggttgcagtgagccgagattgcgccactgcactccaacctgggcaatagaggaagactccggtctcaaaaaacaaaaacaaaaaaacaccttccaaaagcaaatattaagtgacttcctatcgtttctatgactttatgtattatagaattgactttccaagtcagtaattaatgagacttattgagaatttgctgcatagtatctccttggctgtgtccacatgagctaccaccttgcgttaataaatgtgttcgctagggatgttggttttggcattgacagtgttctatcaccaatgcaaataagaccagggaccactcttgagaacattaatgtccaagcatcttaaagttgtacgtaaggctttcataatgtgacttctgctcagctctccatctttagccctttcccctgtgtgccctttctctggccttactgaactgctggtcctgtcctgctgacccatccttcgactgcaggcaaacacatacactctttcaggcctctttctgccttttgttgctgcctgtcatgctctcactctttcctgtcccctaccccttctaattaggctagcctcactctttaagcctcagctcgggcaggatctctagaaaagtcatctctgacatgctttcttttcactctttaaatcctagtgcctagcacatagcaagactcaatacataattgctgagtaaaatagataatgactctttgtacaaagatgattttcaagattgttccctacagtcaaggagcaaagggaatagacatgtaaagcaataattgacagttcgggtggtggagatgcagtagaaaaatcagttctagggcagccctaaggaaggagatacctagatacctgtttacctggggaaagatgaggatgagggtcaacttcacctagcagtctgttttttattttatgtattttatttatttatttttagcagtctgttttaaaagatgaaaatattaatacgtttgtcagaataatacagggaaccatttcagatgttaggaagtggttgtacaccaataaaggtgtccacagtcattttggaaatcattaataaggtactattatgaagtggagaacagtatgcagcattgcctgataatattactactgcattccaaaattttgttttgtttgtgatggctttgttcattgatgttgggtggatgaatctgtgagtgaatcttcaacatgattgtatttctttaacctggtggcatctagtgtctcccagaaagtggtttgttgaagttttggagaattagaagtatttcttaaagaagtaagtattccactaaagatcaagcttcatttaaactctcaatttatgaaataaaatgaaatgtaatttaaaatc

SEQ ID NO: 2443 - DNA, 8686 bp, Homo sapiens
gaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctattgtgaatagtgctgcaatgaacatacgtgtgcgtgtatctttatactagaattagttatattcctttgggtatataccaagtaatgggattgctgggttaaatggtatttcaggttctagatctttgaggaatcaccacactgtcttccacactggttgaactaatttacactcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggtcccgtttcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcactatgctgttttggttactgtagtcttgtagtatgtttgaagctgggtagcatgatgcctctagctttgctcttcttgcttaggattgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgaaccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagagagggcatctttgtcttgtgtcagttttcaagggaacgcttccaggttttcaggtactcaggcaacaaatagcgttacaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcactaggcagatcaccaagacagaaagtcaacaaagaaacaatggacttaaactataccctggaacatatggacttaacagatgcttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaa

SEQ ID NO: 2444 - DNA, 1160 bp, Homo sapiens
ttggcttggccttacccacgaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagat

SEQ ID NO: 2445 - DNA, 941 bp, Homo sapiens
gaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacaggacaaagctatttttaaaacatgtagcccaacagagaagacac

SEQ ID NO: 2446 - DNA, 8912 bp, Homo sapiens
ggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcaggatccagccaaactggactgcacagaattccacagtgctcgtccttctcctccagctctttgcacttgcttctttgctctatctgccaacctttttttctcatccttcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctgctggaggtatcatcagtgaagtctgtgaaacagcaaagatggctgcctgccacttcctctggaagctccagcccagcagcgtactgacttattgctggctcgaaagtgcatgtaaatataaatgtaggtgcataatatagactttttctgaatggtttataagttgcagtgctgggattacaagcgtgagctaccacacccagcgaggaagccaagtttaacgtgtgtgctccactcctccaacctggccaaagggcagtcatcatcactggccactactgaccacagcctttagaaactccccttgaacgtgctgggctgaccttcctctgatcacaggcaaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcagcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctc

SEQ ID NO: 2447 - DNA, 8801 bp, Homo sapiens
ggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaataggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctgctggaggtatcatcagtgaagtctgtgaaacagcaaagatggctgcctgccacttcctctggaagctccagcccagcagcgtactgacttattgctggctcgaaagtgcatgtaaatataaatgtaggtgcataatatagactttttctgaatggtttataagttgcagtgctgggattacaagcgtgagctaccacacccagcgaggaagccaagtttaacgtgtgtgctccactcctccaacctggccaaagggcagtcatcatcactggccactactgaccacagcctttagaaactccccttgaacgtgctgggctgaccttcctctgatcacaggcaaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcagcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctc

SEQ ID NO: 2448 - DNA, 3541 bp, Homo sapiens
cggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtagttatgagagaattccaacaagaatggaccgatctcctaaaacaacaacctacgtcagaggctacctcacgttgtcacattaatttagatgagacacaggattcaaagaagaaattgggtcaaatcagaagtgaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaaggttagctatcttttttccttcggcgttcagatttctgatagaattcttgtatgttatttggtaaaatag

SEQ ID NO: 2449 - DNA, 2823 bp, Homo sapiens
gcagtggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaaggtaacaaagaagcatagagaattcagtcctagagtgcctctgcttggctgcatagagctatagttctgacttaaaaaaactttttctggtaaaatgtgctttgtgtttactcaccttttgcactgaacagaataccttttggcaggatatttgtgttcttcctttaaccaaagcaacatctagataacagagaattaggggaaagcaggattttctttaggaagtaggattatatttagaatatagggactaagtatgtttagggactaacataggattatatttaggataacttagtagagacctaaagattgctgactcaaacacaatgtggtttctttgctttatttttacagctctgaattcacagctgttagttataactatatgcactataatttaaaagacaccttcccacacctgcaatctcagcactttaggaggccgaggtgggtggatcacgaggtcagtagttcgagaccagcctggccaatatggtgaaaccccatctctactaaaaatacaaaaaaaactagccaggcatggtggtgaatgcctgtagtcccagctactcaggaggctgaagcaggagaatcgctggaacccagaaggtggaggttgcagtgagccgagattgcgccactgcactccaacccgggcaatagaggaagactccgtctcaaaaaacaaaaacaaaaacaaaaaaacaccttccaaaagcaaatattaagtgacttcctatcgtttctatgactttatgtattatagaattgactttccaagtcagtaattaatgagacttattgagaatttgctgcatagtatctccttggctgtgtccacatgagctaccaccttgcgttaataaatgtgttcgctagggatgttggttttggcattgacagtgttctatcaccaatgcaaataagaccagggaccactcttgagaacattaatgtccaagcatcttaaagttatacgtaaggctttcataatgtgattctgctcagctctccatctttagccctttcccccgtgtgccccttctctggccttactgaactgctggtcctgtcctgctgacccatccttcgactgcaggcaaacacatacactctttcaggcctctttctgccttttgttgctgcctgtcatgctctcactctttcctgtcccctaccccttctaattaggctagcctcactctttaagcctcagctcgggcaggatctctagaaaagtcatctctgacatgctttcttttcactctttaaatcctagtgcctagcacatagcaagactcaatacataattgctgagtaaaatagataatgactctttgtacaaagatgattttcaagattgttccctacagtcaaggagcagagggaatagacatgtaaagcaataattgacaattcgggtggtggagatgcagtagaaaaatcagtaaagttctagggcagccctaaggaaggagatacctagatacctgtttacctggggaaagatgaggatgagggtcaacttcacctagcagtctgttttttattttatgtattttatttatttatttttagcagtctgttttaaaagatgaaaatattaatacatttgtcagaataatacagggaaccatttcggatgttaggaagaggttgtacaccaataaaggtgtccacagtcattttggaaatcattaataaggtactattatgaaatggagaacagtatgcagcattgcctgataatattgctactgcattccaaaattttgttttgtttgtgatggctttgttcattgatgttgggtggatgaatctgtgagtgaatcttcaacatgattgtatttctttaacctggtggcatctagtgtctcccagaaagtggtttgttgaagttttggagaattagaattatttcttaaagaagtaagtattccactaaagatcaagcttcatttaaactctcaatttatgaaataaaatgaaatgtaatttaaaatc

SEQ ID NO: 2450 - DNA, 3960 bp, Homo sapiens
cttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttaaaacgtctcaagaaccagaaatggctaaggattgtgatagagaggatatacctatatatccagtacttcctcatgtgcaaaaatctgaggaaatgcggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccattcatactaccatccgtactctgggtcccaggaacatgtttgccagtcatcttctaagcttcatttacatgaaaataaattagactgcgacaatgataacaaaccaggcattggacatatttttagtacagataagaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagttgtgcaggagagaaacgatgcccagaagcaactttctgaagaacaggatgccagaatattacaagatcagattctgacgagtaaacaaaaggaactagaaatggctcagaagaaaaggaatcctgagatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaagctgaatggcataaactgttgattgaagaaagagcaaggaaggagatagaagaaaaattaaacgaagccattctcaccttgcagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgacctaactgcagaagtagcaggatccagccaaactggactgcacagaattccacagtgctcgtccttctcctccagctctttgcacttgcttctttgctctatctgccaacctttttttctcatccttcagctgctactaaatatgaacctggatcctatatagcttctcctctaggatttacacacaaggaaaatctgaatcaagatccagttttggaagtagcaaaagaatatgcacagattttaagaagaaaatacatactctg

SEQ ID NO: 2451 - DNA, 3333 bp, Homo sapiens
ataccaaggacgcgacttcttgtttggagagggtggagctttggagtgagacccaggaggccaaatcccaaagagaaaaataggagcctaaataaggatcaggaccaagggaagggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaa

SEQ ID NO: 2452 - DNA, 557 bp, Homo sapiens
acatatcccaggaggcaatgcgcaggggagcacggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagtaa

SEQ ID NO: 2453 - DNA, 3237 bp, Homo sapiens
ataccaaggacgcgacttcttgtttggagagggtggagctttggagtgagacccaggaggccaaatcccaaagagaaaaataggagcctaaataaggatcaggaccaagggaagggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaa

SEQ ID NO: 2454 - DNA, 1535 bp, Homo sapiens
ggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagaccactgaacagcagcaggaaacagagcgatcaaaagaggaggctgaacatgccatcagtcagttccaacaagaaatccagcaacgtcagaacgaagcttcccgggagttccggaagaaggaaaaactagagaaagagctcaagcagattcaggcagacatggacagcaggcagacagaaataaaagccctgcagcagtatgtgcagaagagcaaggaggagcttcagaagctggagcagcagctgaaggagcagaagatattgaatgagagagctgcaaaggaactcgagcaatttcagatgagaaatgctaaacttcagcaagagaatgaacagcacagtttggtctgtgagcagctatcccaggaaaaccaacagaaggcgttggagctcaaagccaaagaggaagaagtccatcaaatgcgccttgacatcgggaagctcaacaaaatcagagaacaaattcataagaaattgcaccacaccgaagatcaaaaggcagaagtcgaacagcacaaagaaaccctaaaaaatcagattgtgggattagagagagaggtagaggcttcaaagaaacaagcagaacttgacagaaaggcaatggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggctgactctgtcaggatgccctggcctctggacaaagggaaatggtga

SEQ ID NO: 2455 - DNA, 466 bp, Homo sapiens
atggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggctgactctgtcaggatgccctggcctctggacaaagggaaatggtgaaacagtggaccctcagggagcttctgagcctctgctgacaagggaagggcacagatcctacccactcatattccaccggccaaccaagtcacagggctgtgccggacatcctgggcaggagtgtggtcctccttagggaggggccctgtagggtgaggcagcaaatatatttgaacataaaatgtca

SEQ ID NO: 2456 - DNA, 3313 bp, Homo sapiens
gcgccgagcgcgggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagaccactgaacagcagcaggaaacagagcgatcaaaagaggaggctgaacatgccatcagtcagttccaacaagaaatccagcaacgtcagaacgaagcttcccgggagttccggaagaaggaaaaactagagaaagagctcaagcagattcaggcagacatggacagcaggcagacagaaataaaagccctgcagcagtatgtgcagaagagcaaggaggagcttcagaagctggagcagcagctgaaggagcagaagatattgaatgagagagctgcaaaggaactcgagcaatttcagatgagaaatgctaaacttcagcaagagaatgaacagcacagtttggtctgtgagcagctatcccaggaaaaccaacagaaggcgttggagctcaaagccaaagaggaagaagtccatcaaatgcgccttgacatcgggaagctcaacaaaatcagagaacaaattcataagaaattgcaccacaccgaagatcaaaaggcagaagtcgaacagcacaaagaaaccctaaaaaatcagattgtgggattagagagagaggtagaggcttcaaagaaacaagcagaacttgacagaaaggcaatggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggtccttatgaacatggaagacataaaagttcgtgaaacacagatttttgactacaggaaaaaaatagctgaatcagagattaaattaaaacagcaacagaacctatatgaagctgtgagatcagacagaaatctgtatagcaaaaatctggttgaggctcaggatgaaataacagatatgaagagaaagttaaagattatgatccatcaggtagatgagctgaaagaagacatctctgccaaagagtccgcacttgtgaagctgcacctggaacagcagcgaatagaaaaggaaaaggaaacattgaaggctgagctgcagaagctgagacaacaagccctggagacaaaacactttattgaaaagcaagaagctgaagagagaaaactcctgcgaataattgctgaggctgacggggagaggttgagacagaagaaggaattagaccaggtcatcagtgagagagatatcctggggtctcagcttgttcggcgcaatgatgagttagctttgctctatgagaagatcaagatccaacagtctgtgctgaataaaggggagagccagtacaaccagaggttggaggacatgagaatcctcagacttgagatcaagaagcttcgccgggaaaaggggattcttgccaggagtatggctaatgttgaagaactcagacaggagttttttcacatgcaaagagaattgttgaaggagaggacacgctgccgagccctggaggaggagctggagaatcccctgaatgtgcacagatggaggaagctcgaggccagcgaccccaatgcatatgagctgatacagaaaattcacaccctgcagaagcgtctcatcagcaagactgaagaggtggttgaaaaagagctgctcctccaggaaaaggagaaactctacatggaactaaagcacgtcttggcccgccagcctggacctgaggctgcggaacagctgaagctgtaccgacgcacgctgcatgacaagaagcagcagctgaaagttttgtcttcagaattgaatatgtatgaagtacagagcaaagaatataaatatgaggtagagaaacttaccaatgagctccagaatttaaagaagaaatacctcgctcagaaacgtaaagaacaacttcaaaaaaacaaggacacagcacccatggataacaccttcttaatggtcaaaccaaatggtcctggttttactgggggcggatttcctctcaggtcaaccaaaatgacgttctaacctgaagctgctggctgtttccagttgaacaactcatgaaatctgctctgggacattttgggggaatctcaaagtccttggatcatagaactgagtgctgagaatccaggatggaaagaaatgcagaactatcatagtcacatacatataagagggatggtgttttgtctggttcacgttgatattaacagatcataattctctctgttcagttaggctgacctattgcatgaagcaaatcttttgttgctaccccattgattgaaatgtactagaccttaatttctttattacagacattggtgtacttgaaggttttatatttaaaagtatttttgaaatgcaatgtgtcccctctcaccttattaacaataatctattttaattattcctcattaacaagtcattgcatgagatgagaaagaaggacaaactcttaagaatttaaaaagtgttttgagaatgatttctatatggaatttcttttcaggcccggaatgggaaaatctattccaaagagacacactaataaatacttcattataaaaaataaaaaagaa

SEQ ID NO: 2457 - DNA, 3122 bp, Homo sapiens
atagagaccgatgctgttcagcgcgagagggcctggagagggtgggtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctacctgctaatgttcatttctgcttgttatttcagaatttgactttttaattatggaagcttcattatcattaatacttctattatttcttgattattataagaggagactcaacctttctctaaatttagaaaccaatttggtacaccatgtttactgcaaaccaatcatccaaacaatttcattttgcaaattagcccttaagaataaattagaaattagaaatagcatttcaagcatgggaatatctgttttggtttggaaatatatatatttgtgtgattgtttagaagaaatatttaaaatttcataatatttggaatgctgtcaaaaattccaaattatctattaaatatttagatgattttatagaaaaggagcatttaaaataaaactcaaacataaatatttgactatttctaaaaaataatttttcaagcagaataacaagttagtgttgttgaaagttgccattgttacagttaagattaccccactcctttttctgtctattgcagctccctgacatttcccacctacctcccaggggttgcagcctctgtgcaattactggaataatgtaaaaaaaaaaaagcccaatccaactagtggaatctttgactttatgattgtccccaacatcatggaaataaaaaatacaagtacagtcccgttagaataaatcttc

SEQ ID NO: 2458 - DNA, 2694 bp, Homo sapiens
atagagaccgatgctgttcagcgcgagagggcctggagagggtgggtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctacctgctaatgttcatttctgcttgttatttcagaatttgactttttaattatggaagcttcattatcattaatacttctattatttcttgattattataagaggagactcaacctttctctaaatttagaaaccaatttggtacaccatgtttactgcaaaccaatcatccaaacaatttcattttgcaaattagcccttaagaataaattagaaattagaaatagcatttcaagcatgggaatatctgttttggtttggaaatatatatatttgtgtgattgtttagaagaaatatttaaaatttcataatatttggaatgctgtcaaaaattccaaattatctattaaatatttagatgattttatagaaaaggagcatttaaaataaaactcaaacataaatatttg

SEQ ID NO: 2459 - DNA, 1447 bp, Homo sapiens
atagagaccgatgctgttcagcgcgagagggcctggagagggtgggtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaagtctcaggtatgtctttatcagcagcatgaaaatggactaatacagtaaattggtaccagtagagtgaagtgttgctgaaaagatacccgaaaatgtggaagtgactttggaactggtatcaggcagaggttggaacagtgtggaaggctcagaagaagacgggaaaatgtgggaaagtttggaacctcctagagactttttgaatggttttgacaaaaatgctgatagtgatatgaacaatgaggtcca

SEQ ID NO: 2460 - DNA, 1792 bp, Homo sapiens
ccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctc

SEQ ID NO: 2461 - DNA, 1501 bp, Homo sapiens
gcgcggggcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaaggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctggg

SEQ ID NO: 2462 - DNA, 3869 bp, Homo sapiens
ccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacagccccggttgaggcctgtgtgctgagtgccagagctggagttttctagcttgtaaatctggagaattaactgatctgaagtgactgggaggggtgagcataaaagccggggaacaggactcccagtggtggtctggttttttttgtgagatgagatgagagctaccacctggaaatgctcattctctgcattcagcctgtctcacatacaggattgtatggccatttcaggtttgggaaagatctacctgctgggagccagtctagtttcctgcaccacctggaacttccaaacccttcactccttcaacagaatgttgaggctgcctcatttgtgccaccaagtacgggaatcttaaagacagaaacagagctcatgaccttttatgggaaagagagaggaaaacaaaacaacttcacaacagcatggcaaggggggatgtggaaccaaggacatgatacagggatgggaaaggagggcatgctcaattctagctggttctttcctttcagataaaaatgagcttttctagttggcatccggcactgcagaaaactaaaagtcatccagccatagctttttccttccctggaaagcctgagactagatcccaaagctcagaatgcctctgagaaccagaatcactcctttgagaggcgctccttgcaggaaaaagagaggctcccagagtggtagcctctcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccaccaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccgaaggaaaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcagtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaatta

SEQ ID NO: 2463 - DNA, 2127 bp, Homo sapiens
aaaatgctacgcttaaattttcctggagtccagatgtccttctgaatccactaaaccttgtgaagcgatgtgaacgtcagtcagcactacttattcataagtagtggatagttgccacgtcattaactcatcatcatcaccatcatggtcgtcatcgtcgtcgtcatcatcatcatcatcgccagagcggccacttgggattctgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatgg

SEQ ID NO: 2464 - DNA, 3047 bp, Homo sapiens
acgcattccctgagcgccgccggatgccggcctgggtcccgcccagggctgagggccctcctgggccgggaaaactacagttcccgacatgccctgccacgggtgcgcctgcgtaccggagctactgcgccggggagcgggttggtttaaaatgctgtgttagttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaagaatgcagccattattgaagaggaactgaagaccacaaaacgtaaaatgaaccttaaaattcaagagcttctagagatgacctcatttccaagttggttgaagaaaataagaacctgcagatatctttcaacaaggaacatgaagaaaatgcatatttgaggtccgaaataatgtctcttcatgaagcatcagaaaaagcacaagttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggaggttaataaaacagaaaaagaaatagtgcaagaaagatgcaatttggaaaaggaattagctaaaaacaaggtagacataaatacattaactcataacctgcagactcttgaagaagagaataagcacctggcagatcaaatggcttccctagaacttcagcaagtcacttctgattaccatgggcttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgatagg

SEQ ID NO: 2465 - DNA, 3685 bp, Homo sapiens
agttcccgacatgccctgccacgggtgcgcctgcgtaccggagctactgcgccggggagcgggttggtttaaaatgctgtgttagttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaggctatttggaagctccagactgtttagaagacctggacagccagaaagtcattagtcctatccaaaatgaagcaatttgtgcaggaaaaacagatattttatggaagaactgtgagtttctggtaaatcgaatgtgccgtcttgaaagcctcatgcagtccttgaagatgaacatctttcggctgcaaactgaaaaggatttgaatcctcagaaaacagcttttctgaaagatcgactgaatgcaatacaggaagagcattctaaggacctgaagctgttgcatctcgaagttatgaatttgcgccagcaactgagagctgtaaaagaggaagaagacaaggcacaagatgaggtgcaaaggttgactgccactctgaagattgcctcgcagacaaagaagaatgcagccattattgaagaggaactgaagaccacaaaacgtaaaatgaaccttaaaattcaagagctaaggagacaactggctcaggagaagtaccttagggaatctttagagaaatcagcatcagccatgctcctcaaaatacaagaaatgggatcaacagtggaggtagaacgaaaacaggtgcacattttgcagcaaaactgcattgctctacgtgattctatacagagcgctcaagaactactggcccaggaacaaaaaaaaaaagaagagttggagattgctacttcacagctcaaatctgatctaacttctagagatgacctcatttccaagttggttgaagaaaataagaacctgcagatatctttcaacaaggaacatgaagaaaatgcatatttgaggtccgaaataatgtctcttcatgaagcatcagaaaaagcacaagttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggaggttaataaaacagaaaaagaaatagtgcaagaaagatgcaatttggaaaaggaattagctaaaaacaaggtagacataaatacattaactcataacctgcagactcttgaagaagagaataagcacctggcagatcaaatggcttccctagaacttcagcaagtcacttctgattaccatgggcttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggcaaactcagaactcagtgccaagagggtacacctgcagcaggcagatgctcacctgaaagaagtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatgg

SEQ ID NO: 2466 - DNA, 2243 bp, Homo sapiens
ttaaaggaggcctcattagatgcgctctctgacagggaagttggcataaggtctgtttctttgctgggtcatattttacagtgtgatctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgata

SEQ ID NO: 2467 - DNA, 919 bp, Homo sapiens
agttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaacctgcagatatctttcaacaaggaacatgaagaaaatgcatatttgaggtccgaaataatgtctcttcatgaagcatcagaaaaagcacaagttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggagggctatttgtgaagtctgctctgcctcagagactccctgattggccccttttctgagaggatgtgctatctctgcagtgttaataaaacagaaaaagaaatagtgcaagaaagatgcaatttggaaaaggaattagctaaaaacaaggtagacataaatacattaactcataacctgcagactcttg

SEQ ID NO: 2468 - DNA, 1266 bp, Homo sapiens
aaaatgctgtgttagttccacggaaacccgctcgcctgctgcagtacggagcctcaggcggacagatggactgtaagaggctatttggaagctccagactgtttagaagacctggacagccagaaagtcattagtcctatccaaaatgaagcaatttgtgcaggaaaaacagatattttatggaagaactgtgagtttctggtaaatcgaatgtgccgtcttgaaagcctcatgcagtccttgaagatgaacatctttcggctgcaaactgaaaaggatttgaatcctcagaaaacagcttttctgaaagatcgactgaatgcaatacaggaagagcattctaaggacctgaagctgttgcatctcgaagttatgaatttgcgccagcaactgagagctgtaaaagaggaagaagacaaggcacaagatgaggtgcaaaggttgactgccactctgaagattgcctcgcagacaaagaagaatgcagccattattgaagaggaactgaagaccacaaaacgtaaaatgaaccttaaaattcaagagcttctagagatgacctcatttccaagttggttgaagaaaataaggttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggagggctatttgtgaagtctgctctgcctcagagactccctgattggccccttttctgagaggatgtgctatctctgcagtgttaataaaacagaaaaagaaatagtgcaagaaagatgcaatttggaaaaggaattagctaaaaacaaggtagacataaatacattaactcataacctgcagactcttgaagaagagaataagcacctggcagatcaaatggcttccctagaacttcagcaagtcacttctgattaccatggggtgg

SEQ ID NO: 2469 - DNA, 2112 bp, Homo sapiens
agttcccgacatgccctgccacgggtgcgcctgcgtaccggagctactgcgccggggagcgggttggtttaaaatgctgtgttagttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaggctatttggaagctccagactgtttagaagacctggacagccagaaagtcattagtcctatccaaaatgaagcaatttgtgcaggaaaaacagatattttatggaagaactgtgagtttctggtaaatcgaatgtgccgtcttgaaagcctcatgcagtccttgaagatgaacatctttcggctgcaaactgaaaaggatttgaatcctcagaaaacagcttttctgaaagatcgactgaatgcaatacaggaagagcattctaaggacctgaagctgttgcatctcgaagttatgaatttgcgccagcaactgagagctgtaaaagaggaagaagacaaggcacaagatgaggtgcaaaggttgactgccactctgaagattgcctcgcagacaaagaagaatgcagccattattgaagaggaactgaagaccacaaaacgtaaaatgaaccttaaaattcaagagctaaggagacaactggctcaggagaagtaccttagggaatctttagagaaatcagcatcagccatgctcctcaaaatacaagaaatgggatcaacagtggaggtagaacgaaaacaggtgcacattttgcagcaaaactgcattgctctacgtgattctatacagagcgctcaagaactactggcccaggaacaaaaaaaaaagaagagttggagattgctacttcacagctcaaatctgatctaagtatgaaaatagatgctagaaatcaccctcttgttagtttttggagatttcatggaaaaactcttaagatcccaaattcttaaagtggccagtgttattggtatttcccacagtgctgtatgtaaaacattgcagatttcccttctacctgcagtactgagatacagaaggattgttgttaataatatatttgaccctgttaattgtaaactattccttatttgtttttttccagcttgtttgtggacctgggaatatttggtttctagacatctggcttgaatattgggcaaaaaaagtaaaacaatagattgaatatttgataatagaatattagtaaggtagtaaggccatgaatccttgatgacttatggattctgtcagttcatcatgtcagattctccattcttcatgttatcaatctattttggttaacctatatttgtagagatggatagttgtaaggtacctttaagagagcttagattaatctcctctttttatagatgagtcctcaaagatgacagagctaggaaaggaaggagcctagacttgatcccaaggtgttcggtcatatttcttctaacccatcagccttttatcatactactgttgctagtacttcattataaagcagtttccaggtagtctcaatgacagaggtcacagagttacagggcagtgcttcatgtgattaatacatcatggtttacactgaactttcacataaactatttcattcagtactcaaagctatccttccagagttacaaaaggaaaaaatggcaaagtaagacctagacctggatcttctaactccaagccgagtgtactctccagttcaccttctgtgctctatggctgctgtaatgggggcagagaataccaaaaaggaaatggaaattataaaaaatatagagcaagagtaatctattcaatgttttgacttactgcttttagcagaaagtattcccttttcttatagtagtgaattactgtgtgaagttctcaccgacaatgcccctggataattttctgtctttctgtaattgtgtgcctacaaaaatacatgtatattttatggtg

SEQ ID NO: 2470 - DNA, 2161 bp, Homo sapiens
gagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 2471 - DNA, 1955 bp, Homo sapiens
ctgcctcctcaggaccaggcttcgacgccctcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 2472 - DNA, 1867 bp, Homo sapiens
cacacccacacatgcaccctccggttgccccctgtaagaaactgaggtgccctcccacccgctcgttcacacctacacgaggccggagcaaagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 2473 - DNA, 3431 bp, Homo sapiens
ccggaggaggggacagcattcaggggtgtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggaatataagaataatattgccaaacttgtaagtgaaatgaaaatcaaagaggagggatataagaaagaaataagcaaactttatcaggacatgcagagaaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtcagctttaaggtttttattgaatttatttggacaaatccgtactgtatccaattctgtactgcattcttgcttaatagtattaaccataaaggaggtcaggtttatagggtttggtttacctattaaaccatcattgactatggaaatacttactaagcaatatagagacagacaatattatctttccccttatatcttttaagacagccactcaagttttagaagagtatgatacaacattagagaaagaaagatacaaaggctttattcatgtgtgatagtaaaaatcaggatgagtcttagatatacaaaagataaatggatatttaaaatagttatatatgcttttttagcaaaatattcacgtgttaagtatttctggatcttaaaatacaaaatccacttattttattagttaaaagtagaagattgaaaagacaaagtaatattgttttgagagataagtaaagaaaaaaatggaaagcatgtctttgttgttcttcctccattctaaactgctaattatccaacagaaacccctaggtcatagtttacgtttctattctcattaaagcaaatagaacactggaaaaagaaaaaaaaagacatattaaccaaaagctgcaatcacctttcagttgctccatcataaaaaatatggtttgagtcaatatttctatgacataaaatttaaaatctggaagccaattcagtagatttctccatgtttgcacaaatctaatttctatttttggttcactaatttggtagtttataaaaatgctggaaatgaaattgtgtctagactaaattggggagtatgtcctattttaaatatttagtttgaaggtcattctcacttttttgcctgattctttcagcgtcaactggcactggcttctgtgggtataagctgctgacttatttgtcaggcagctggaggcaaacgtcactgacaagattcagttatgttctcctctgcccgaagtccctgtcagctacataaagatgggaggttttctttacactgtcaggtgattgcagaccctgttttttcaaatatcagatgtcgacaatggcagcatcagctcctaggagccaactctgaatctgtgggcaatttacagagtaattgatttatacatctctttcgacagagcttcttttgtaaatcttgtaaatcttcacttgctggcatatctcggttctctgggtgaccctgcctatgctgacccttgtgcttatggtggtgatgaaggcctggaggagcaggatgagtaggagcatttggtgctcctggttgctgattctctgaaagctcactgctgccaaggtgctgatgtccatgattgtgatgatgctcatgatggtaatgaggcgatggagtttcaactgttttatccacagtagccaaagatacacgtttacaaaagtcttcatctttgagagtctggaacaaatttataaatcactttttaacaagcttatagagataggaataatgcgtgaaaaatgatttgtagagctaacatgtgaaattccaactagttaattagaatcgagctggctttgtattatattaatgagaaagagtctgatgttagtctcaacacctagacattttattaaaggcttaaaaagaaagccaaaccactgtacttatatttgcagaagcaaatgaagtaaactggcaaaaggaacttggattgcaggaaagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaagatggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgttagtttttcatacttcatcctatgccaggaaatgttttgaacttcaccaaagctttgctaatgtctccctaccataaggctgtcagctgaaaatagcaaattactgcccgactcccattgaccataatatccattccgcatgatcctagttctttaatttactggaagtctttactgttttgtggtacctactaatcagagactcaaagcctatagatacagaaatgtaacagtaaatctcaacctaaggctaatttgcaaataaaattacaaaatcaacttagaacccaaa

SEQ ID NO: 2474 - DNA, 765 bp, Homo sapiens
ggccttctctctgccactccccacgagtgggtcactccacggggagccccaacgctggcaggagaggatcctacaggacagcaaggagatgccacctaaaaacaaagaaaaagggaagaaatctggggcacagaagaagaaaaagaactggggtgcagatgtggtggccgagtccaggcacaggctggtggtgctggagaaggagctgctccgagaccacttggctctacggagggatgaagcccgtcgagccaaggcttccgaagaccagctgaggcagaggctgcaaggggtggaggctgagctggaaggggcccgaagtgaagggaaggccatatatgcagagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactc

SEQ ID NO: 2475 - DNA, 1295 bp, Homo sapiens
atgccacctaaaaacaaagaaaaagggaagaaatctggggcacagaagaagaaaaagaactggggtgcagatgtggtggccgagtccaggcacaggctggtggtgctggagaaggagctgctccgagaccacttggctctacggagggatgaagcccgtcgagccaaggcttccgaagaccagctgaggcagaggctgcaaggggtggaggctgagctggaaggggcccgaagtgaagggaaggccatatatgcagagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactcaatagagctgtgggctctggccgtttggcagagagaagtggatcttatttttatttttatttttatttagttttcttctttttttgtttttgttgttgtttatttttaggagtggctgtcatacagacatctcagttctgggttgacccattatccctgagattcagtgattgataggaaataaatttgaccaggtctcaacctctctcctgcaggagccgcatcccaccccttgagcctgaggcccttttggtcccttcacaccactgccccttacccccaccaacacaaacacaggcagtcagatttatggcgaatggccatttctataacaaatgcaacggtgaccaagcaccaccctcccgcaatgctaaggcacccacagagggcaggcatagctggtctccaaatttttgcattacactcaagggtcctggagtcatatctagaaaaggtccagatggcttcaatcctagccagacccacagccacaccttcatccttgggacacagctctctaaaactcccatatgacatcctctggagcctcagactccttcagggacctgtctgaggcctccaaccacaccctctgctggcaggtgggcctgcaggaag

SEQ ID NO: 2476 - DNA, 2212 bp, Homo sapiens
gaaggcagccagacgagggcagcagctcgtccctcaaggcccagagctctcacgggacttcctctggctcctgacccccctggcctgtgcccagctctgggcaacctcagaggccccaaggcccaagctacagccgagggcagggtggccggtgcagcccagcagccatgtcagagttggctgacagtggaccctcaggggcatcggccccttcccagctgagagccgtcaccctggaagacctggggctcctcctggcaggaggcctggccagccccgagcccttgagcctggaggagctctcggagaggtatgagtccagccatccgacatccacggcctctgtccccgagcaggacaccgccaagcactggaaccagctggagcagtgggtggtggagctgcaggccgaggtggcctgcctgcgggagcacaagcagcgctgtgagcgcgccacgcggagcctgctgcgggagctgctccaggtgcgggcccgcgtgcagctgcagggctcagagctgaggcagttgcagcaggaggcgcggccggcagcccaggcccccgaaaaggaggcgccggagttctctggtctccagaaccagatgcaggccctggacaaaaggctggtggaggtccgggaagccttgacccggctcaggaggaggcaggtgcaacaggaggcggagagaaggggcgccgagcaagaggccggcctcagactggccaagctgaccgacttgctgcagcaggaggagcagggccgggaggtggcctgcggcgccctgcagaagaaccaagaggacagcagccggagggtggacctggaggtggccagaatgcaggcccaggtgaccaagctcggcgaagaggtgagcctgcgcttcctgaagagggaggccaagctgtgcggcttcctgcagaagagcttcctggccctggagaagagaatgaaggcctcggagagctcacggctgaagctggagggcagcctgcggggcgagctggagagccggtgggagaagcttcgggggctgatggaggagcgcctgcgggccctgcaggggcagcatgaggtggggccgggcgggcggcgggcagaggagagccacctcctggagcagtgccagggcctggatgctgccgtggcccagctgaccaagtttgtgcagcagaaccaggcgtcgctgaaccgtgtcctactggccgaggagaaagcctgggacgccaaggggcgcttggaggaaagccgggctggggagctggccgcctatgtgcaggagaacctggaggccgcacagctggctggcgagctggcccggcaggagatgcatggagagctggtgctgctccgagagaagagccgggctctggaggcatccgtggcgcagctggccgggcagttaaaggagctgagtggccatctcccggctctgagcagccggctcgatctgcaggagcagatgctgggcctcaggctgtccgaggcaaagaccgaatgggaaggtgcagagaggaagtccctggaggacctggccaggtggcggaaggaggtgaccgaacacctgcgaggggtgcgggagaaggtggatggcctcccccagcagatagagagtgtctccgacaagtgcctgcttcataagagcgactcagacctcaggatttccgccgaaggcaaggccagggagttcaaggttggggccctgcggcaggagctggccacgctactatcatccgtgcagctgctaaaggaagacaaccctgggcggaagatcgcggagatgcagggcaagctggccacgaaccaaataatgaagctggaaaactgcgtccaggccaacaagaccatccagaacctcaggttcaacactgaggcccggctgcgcacgcaggagatggccaccctgtgggagagtgtgctccggctgtggagtgaggagggcccgcggacgccgctgggcagctggaaggcgctcccatccctggtgaggccgcgggtcttcatcaaggacatggcgcctggcaaggtggtgcccatgaactgctggggcgtgtaccaggctgtgaggtggctgcgctggaaggcgtccctcataaagctcagggccctgcggaggccaggaggggtcctggagaagccccacagccaggagcaggtgcagcagctcacaccctcactgtttatccagaaataaacgtgctggctttgtactca

SEQ ID NO: 2477 - DNA, 2564 bp, Homo sapiens
tctggggagagaaggaaggttctggaacggccccgctgccccacacctgcctccctggggaccctgagaaggcagccagacgagggcagcagctcgtccctcaaggcccagagctctcacgggacttcctctggctcctgacccccctggcctgtgcccagctctgggcaacctcagaggccccaaggcccaagctacagccgagggcagggtggccggtgcagcccagcagccatgtcaggtgaccagagcggaggagcggggcccagggaggggcttgccacaggtgtgagggtggggaccgctctgcttctgaccccgggctccctccagctcgcttgttcctgccgcccagtgctgtgtgtcttcaggcagggccctggacttgtctgagccaagcccgtctggatcctgtgtgacccaaggagacgcgttgagctctgggtggtgggcgagggtcctgcgggggtttggggccttgttcccgtaagctccagtgggggccgggccccaaggggcaagctcccaagatgcctccttgtagagttggctgacagtggaccctcaggggcatcggccccttcccagctgagagccgtcaccctggaagacctggggctcctcctggcaggaggcctggccagccccgagcccttgagcctggaggagctctcggagaggtatgagtccagccatccgacatccacggcctctgtccccgagcaggacaccgccaagcactggaaccagctggagcagtgggtggtggagctgcaggccgaggtggcctgcctgcgggagcacaagcagcgctgtgagcgcgccacgcggagcctgctgcgggagctgctccaggtgcgggcccgcgtgcagctgcagggctcagagctgaggcagttgcagcaggaggcgcggccggcagcccaggcccccgaaaaggaggcgccggagttctctggtctccagaaccagatgcaggccctggacaaaaggctggtggaggtccgggaagccttgacccggctcaggaggaggcaggtgcaacaggaggcggagagaaggggcgccgagcaagaggccggcctcagactggccaagctgaccgacttgctgcagcaggaggagcagggccgggaggtggcctgcggcgccctgcagaagaaccaagaggacagcagccggagggtggacctggaggtggccagaatgcaggcccaggtgaccaagctcggcgaagaggtgagcctgcgcttcctgaagagggaggccaagctgtgcggcttcctgcagaagagcttcctggccctggagaagagaatgaaggcctcggagagctcacggctgaagctggagggcagcctgcggggcgagctggagagccggtgggagaagcttcgggggctgatggaggagcgcctgcgggccctgcaggggcagcatgaggagagccacctcctggagcagtgccagggcctggatgctgccgtggcccagctgaccaagtttgtgcagcagaaccaggcgtcgctgaaccgtgtcctactggccgaggagaaagcctgggacgccaaggggcgcttggaggaaagccgggctggggagctggccgcctatgtgcaggagaacctggaggccgcacagctggctggcgagctggcccggcaggagatgcatggagagctggtgctgctccgagagaagagccgggctctggaggcatccgtggcgcagctggccgggcagttaaaggagctgagtggccatctcccggctctgagcagccggctcgatctgcaggagcagatgctgggcctcaggctgtccgaggcaaagaccgaatgggaaggtgcagagaggaagtccctggaggacctggccaggtggcggaaggaggtgaccgaacacctgcgaggggtgcgggagaaggtggatggcctcccccagcagatagagagtgtctccgacaagtgcctgcttcataagagcgactcagacctcaggatttccgccgaaggcaaggccagggagttcaaggttggggccctgcggcaggagctggccacgctactatcatccgtgcagctgctaaaggaagacaaccctgggcggaagatcgcggagatgcagggcaagctggccacgtttcagaaccaaataatgaagctggaaaactgcgtccaggccaacaagaccatccagaacctcaggttcaacactgaggcccggctgcgcacgcaggagatggccaccctgtgggagagtgtgctccggctgtggagtgaggagggcccgcggacgccgctgggcagctggaaggcgctcccatccctggtgaggccgcgggtcttcatcaaggacatggcgcctggcaaggtggtgcccatgaactgctggggcgtgtaccaggctgtgaggtggctgcgctggaaggcgtccctcataaagctcagggccctgcggaggccaggaggggtcctggagaagccccacagccaggagcaggtgcagcagctcacaccctcactgtttatccagaaataaacgtgctggctttgtactcatta

SEQ ID NO: 2478 - DNA, 3001 bp, Homo sapiens
cccttcatagcggccggccgcttattcctgtgcgagtaaggagcgcccaggccaaccctccggctgcaggctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccgcgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacgaccttcaagaacaccaggagtgtccactcccagaccattgagacggccctggtgccctgtgacgcatgcgccagcgtccagggaagcctgcagaaggtgggcaaggtggtcatcagcctgtgtcagagccagaacctgccctcgtccttaggccagttccagcaactggtgcaggacagcatggggctcaggccactgccggctgccaccgtgggccgctgggcagcagagcagaggaaagacctgacgcgcctcagtaagcatgtggaggccctcagggcccagctggaggaggctgaagggcagaaggatggcctgaggaagcaggcgggcaagctggagcaggcgctgaaacaggagcagggggcacggcggcgacaggcggaggaggatgagcagtgcctgtctgagtgggagcacgacaaacagcagctgctcacagaaacaagtgacctaaagacaaagatggccaccctggagagagaactgaaacagcagcgggagtccacacaggctgtggaggcaaaggcccagcagctgcaggaggaaggtgagcgcagggcggcagcggagaggcaggtgcagcagctggaggagcaggtgcagcagttggaggcgcaggtgcagctgttggtgggtcggctggagggcgctggccagcaggtctgctgggccagcacggagctggataaggagaaggcccgtgtcgacagcatggtccgccaccaggagtctctgcaggccaagcagcgagccctgctaaagcagctggacagcctggaccaggaacgtgaggagctgcggggcagcctggacgaggctgaggcccagcgggcccgcgtggaggagcagctgcagagcgagcgggagcaggggcaatgccagctcagggcccagcaggagctgctgcagagcctgcagagggagaagcaaggcctggagcaggcgactacggacctgcggctaaccatcctggagctagaacgggagctggaggagctgaaggagcgggagcggctgctggtggccttcccagacctgcacaggcccaccgagacccagatccatggaggcagatccagcagcgtggaatcccagataacatgtcccacagactctggcaacgtcacagatcacatggagaggcaagtgcagtccaacgacatccgcatccgggtcctacaggaggagaacgggcggctccaatcaatgctgtccaaaatccgggaagtggcccagcagggtggcctcaagctgatcccgcaggaccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagc

SEQ ID NO: 2479 - DNA, 3052 bp, Homo sapiens
aagcccttcatagcggccggccgcttattcctgtgcgagtaaggagcgcccaggccaaccctccggctgcaggctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccgcgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagagcagccacgtggctctggctggcagggctcttctctgctcaccccaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacgaccttcaagaacaccaggagtgtccactcccagaccattgagacggccctggtgccctgtgacgcatgcgccagcgtccagggaagcctgcagaaggtgggcaaggtggtcatcagcctgtgtcagagccagaacctgccctcgtccttaggccagttccagcaactggtgcaggacagcatggggctcaggccactgccggctgccaccgtgggccgctgggcagcagagcagaggaaagacctgacgcgcctcagtaagcatgtggaggccctcagggcccagctggaggaggctgaagggcagaaggatggcctgaggaagcaggcgggcaagctggagcaggcgctgaaacaggagcagggggcacggcggcgacaggcggaggaggatgagcagtgcctgtctgagtgggagcacgacaaacagcagctgctcacagaaacaagtgacctaaagacaaagatggccaccctggagagagaactgaaacagcagcgggagtccacacaggctgtggaggcaaaggcccagcagctgcaggaggaaggtgagcgcagggcggcagcggagaggcaggtgcagcagctggaggagcaggtgcagcagttggaggcgcaggtgcagctgttggtgggtcggctggagggcgctggccagcaggtctgctgggccagcacggagctggataaggagaaggcccgtgtcgacagcatggtccgccaccaggagtctctgcaggccaagcagcgagccctgctaaagcagctggacagcctggaccaggaacgtgaggagctgcggggcagcctggacgaggctgaggcccagcgggcccgcgtggaggagcagctgcagagcgagcgggagcaggggcaatgccagctcagggcccagcaggagctgctgcagagcctgcagagggagaagcaaggcctggagcaggcgactacggacctgcggctaaccatcctggagctagaacgggagctggaggagctgaaggagcgggagcggctgctggtggccttcccagacctgcacaggcccaccgagacccagatccatggaggcagatccagcagcgtggaatcccagataacatgtcccacagactctggcaacgtcacagatcacatggagaggcaagtgcagtccaacgacatccgcatccgggtcctacaggaggagaacgggcggctccaatcaatgctgtccaaaatccgggaagtggcccagcagggtggcctcaagctgatcccgcaggaccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagcaa

SEQ ID NO: 2480 - DNA, 1886 bp, Homo sapiens
gcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaagacagaagagctggaaaagcagttagtccttgccaactcagagctaactgaagcccggacagagcgtgatcaatccagcctgagatcagacatgtgccatagaagcaacaactcgttgagggactccactgaaggaagcaaatcaagtgaaactcttagtagagagccagtcacattacacgcaggagacagggaagatccctctggttgcttcacattcacatctgcagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactcta

SEQ ID NO: 2481 - DNA, 3626 bp, Homo sapiens
gcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaagacagaagagctggaaaagcagttagtccttgccaactcagagctaactgaagcccggacagagcgtgatcaattcagtcaggaatctggaaatttagatgatcaacttcaaaagctgttggctgatctacacaaaagggagaaggagctgagtctggagaaggagcagaataagcgtctgtgggaccgagacacaggcaacagcatcaccattgaccacctgcggcgggaactggacaaccggaacatggaggtgcagcgcctggaagccctgctcaaggccttgaagagcgagtgtcagggccagatggagcggcagatggcagcaattcaaggaaagaatgaaagtctagaaaaagtatcctccttgactgctcagcttgaatccaccaaagagatgctgcgcaaagtagtagaagagttgacagccaagaaaatgactctggagagctcagagaggacaatatcggacctgacaacttctctccaggaaaaagagagagccatcgaggctaccaatgcagagatcacaaagctccgctcccgggtggacttgaaattgcaggagctgcaacacttgaaaaatgaaggggatcatctcagaaatgtgcagacagaatgtgaggccctcaaactgcagatgacagagaaggacaaggtgatcgagattctgcgacagcagattgagaacatgacacagctggtgggccagcatggacgaactgctggagctatgcaagtagaaaaagctcaactggagaaagaaattaatgataggcggatggaactaaaggaacttaagatattaaaagataaaaaagatgcaaagatccgggagcttgaggccagagtgagtgacttggagctggaaaaggtgaagctggtgaatgcaggctctgagcggctccgtgcagtgaaggacatcaaacaagagagagatcaattattaaatgaggtgaaaacaagtaggagtgaattaaacaatctttcagaggagtatgaagtcttaaaaaggaatttccgaaacaaaagtgaagaaatggaaatgactacaaataagttgaaaatgcaattaaaatctgcacagtctgaactagaacagacaagaaatacattaaagtcaatggaaggatctgatggtcatgctatgaaagtggcaatggggatgcaaaagcaaatcacagccaaaagaggtcagatagatgcccttcagagcaagatacagtttttggaagaggcaatgacaaatgcaaataaggagaaacattttctgaaagaagagaaaagtaaactcagtcaggaattgagtactgttgccacagaaaaaaacaagatggctggggagttggaagttctgcgatctcaggaacgccgtttgaaagaaaaggttactaatatggaagtggctctggataaggcatctttgcagtttgcagaatgtcaagatataatacagcgtcaggagcaagaatcagtgcgcttaaaacttcaacacactttggatataaaagaacttcagggccctggatacacctcaaattcttcattgaaaccacgccttctccagccagcatctgttactcgttctcattctaatgtaccatcttcgcagtctacagccagcttcctgtctcatcactctacaaaagctaacacactgaaggaagatccaacaagggacctgaaacagcttctccaagagttgagaagcgtgatcaatgaggagccagctgtgtctctgagcaagacagaggaagatggaagaacatctctgggagccttagaggatagggtaagagattgcattactgaatccagcctgagatcagacatgtgccatagaagcaacaactcgttgagggactccactgaaggaagcaaatcaagtgaaactcttagtagagagccagtcacattacacgcaggagacagggaagatccctctggttgcttcacattcacatctgcagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactcta

SEQ ID NO: 2482 - DNA, 1735 bp, Homo sapiens
cgggtgtagatttcacaacccagggggcggagccaggatgatgaccccgccccctccctaaataattctcccgggagggacacggaagcagcaaccgggatgggacggggagagaggaggcactactggggacctaagctggttctcaaatgcctctccttttcccctccaagcctcccaggcttcctatggtccctaagtcccgggttctcagcgtgacattccagagcaaacacagctccccattactctataccaggcactggcatggattaatttatctaatcacaacatcccagtaagatatgccctgcctctcctgctcacactctatggctggcattcacctgtggggccaggtcgaaactcctggcttggccgtcaatgccttactggagctgctctgctaacctcctgctgcttcctctcggacctcgattcagccatcatgaatttaccagcatagagcatgtgattccacacctccaagcttttgcacatgctgctccctgccagcgaccctcttttggccggcctaccccgggaccctgactactctgtgtcctgcctctactcacctccctcaccctccagcatgtgtttgcctgctaacatgaagtgtgacaagtactggggctcttcctcggacaaggctctggagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccggt

SEQ ID NO: 2483 - DNA, 1062 bp, Homo sapiens
acacccctctctgtgactcagtctctgagcgttttaatacgatggtgtccccgcgggatcaaacttcagcgtcacagctgaggactggcttcgtggtccctgatgggagagcatgaacaggtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccgcttgagcagccgggactgctctccctgaagacccctccagagagaaaataaactagcccagaccctcctct

SEQ ID NO: 2484 - DNA, 1408 bp, Homo sapiens
aagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccgcttgagcagccgggactgctctccctgaagacccctccagagagaaaataaactagcccagaccctcctcta

SEQ ID NO: 2485 - DNA, 1299 bp, Homo sapiens
aagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccagatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatctaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaa

SEQ ID NO: 2486 - DNA, 1790 bp, Homo sapiens
aagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccagttcaaactggagaaggagggcagagatatccagtagacagaagatcttggaccccaggaagtatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatctaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaaaacttaaaaaaatccttccagtaggcaagtcattgagccaaatcagtgtttattgtattttctttgcgtattacttaaaatatatgtaataggatgttattttcattttcagtaaatcacagtatctataaaacatatacatgtttccaagcttctgctttctctttctgatgaagttattgcaggaatacaaatggaaacgaagctttggaaatctcatatcagagtgtgtgtgtgtgtgtgtgtgtgtgtgtgtacacacacacatatattcactcaaaaacacataatgattcaccaaatcatttatgaatacaaatcagcaattttgtgatctcgtaagcaaatatgtctttggcacgtgaatatttttccatctgtgttcattgatgttaacaataaaaatcttgtttatgtgtataagcctaa

SEQ ID NO: 2487 - DNA, 2491 bp, Homo sapiens
gtttgttcctagcaaccagcctgaggtctggaggtggtgcggagggagccgcctagggaccagggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcgggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggattgagaagctggagaatgaagttaagaccagccaggacaaattcgatgaaatcacctcaaagtgggaagagggcaagcagaagagaattccccaagagctgtgggaaatgctcaatacccaacagctgcactgtgctggactcttagaagataagaataaactcatcagcgagttacagcaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgagaaagcatttgaggtggaacgccaagagctactggccagtaataagaagaaatgggagcaagcccttcaggctcataatgccaaagagctggagtatcttaacaaccgcatgaagaaagtagaggactatgagaagcagctgaacaggcagaggatctgggattgcgaagaatacaacatgatcaagatcaagctggagcaggatgtgcagattcttgagcagcagcttcagcagaggaaagcaatttatcagctaaaccaagagaaattagagtacaacttgcaggtgctgaagaagagagatgaagaaagcacagtaattaaatcccagcagaagaggaagatcaatcgcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagttttgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaagaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatgagctggaccgccaaaggctgatgtgttagggctggcctgatgctggtgtctgtgccggagccagctcatatcacccactgggccgcacctgggcctgctctctggattttccagggctgtctttatagcctgtcgaaataaggagccagaggagttacctgtgtcctgcattatgattaaagccttttaaagttg

SEQ ID NO: 2488 - DNA, 582 bp, Homo sapiens
aatctgttgcaggtttagagactatatagccacttgctagatcatctctgaaataagaataaatgggctcacactctccctcccacttcctggttcatggctggattttgagtatgatgtttccagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaagaagaggaggagaccccaccctccccct

SEQ ID NO: 2489 - DNA, 6065 bp, Homo sapiens
gagtgttttcagaagtgggaatagcaggcgaggtcttgaggcctgaagaagcaaagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagctcaggggcccccccgttttacctgagcagagtgtatccatagaggagctacagggtcagctcgtgcaggcggccagactgcatcaagaggagacagagacatttacaaacaagatccataagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagaattgttgtggatatcccagaattaacattgaggaggagactttaggcttcaccaggctgccagctgggtccacggtaaaaacgttgaagagccttgggttgcagagattggagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 2490 - DNA, 6093 bp, Homo sapiens
gagtgttttcagaagtgggaatagcaggcgaggtcttgaggcctgaagaagcaaagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagctcaggggcccccccgttttacctgagcagagtgtatccatagaggagctacagggtcagctcgtgcaggcggccagactgcatcaagaggagacagagacatttacaaacaagatccataagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggca

SEQ ID NO: 2491 - DNA, 5969 bp, Homo sapiens
gagtgttttcagaagtgggaatagcaggcgaggtcttgaggcctgaagaagcaaagcgtcgcttagtcaatgctgagatgcgtcttgtggaacagaatttttgggacatttgcaggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagagagttccctaaaaagaagaagcactcgggaaatgtacaaggagaagaaaacctttaaccaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacacgctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcccgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 2492 - DNA, 1320 bp, Homo sapiens
atggcgcccaagaaaaagcgcgggccgagcgcagggagccagccaggtggtgcggcggccgcgggtgccgagcagccgctatcggagcgcgcgcagtacctgcaacgcgaacacgcgctgctctcggagcagctggacacctgcgaggagagcgttgaccaggtgctgcgagagaacgccttcctggaccgcgaggcgctgcgcctgcgcgaggagaaccggctctacgccagctacgtgagcgcgcgcgcccagcgctgcgccaaagccatcgtccggctggacgagcagaaccgcgtggacctagcgcagatccactggcagcgggcggaactggcctcgctctaccacgggcgcgaggacggggtgcgcgcgcagctgttggagatggaggcgcgcgcggcacagatggcacagcaggtgcaagagctgcagccctacaaggtgctgcagctggagcagctggcccggatccgggcgctggagcgcgagctgctgcatatgcgcgtggagcacacgcagctgctccaccgcgtgaagcggcgcttcctggaggacaaggcggccttcgagcgcgaggcgcgtcagcgcgtgcagtcactggcgcggcgcgcggagcgggaggcggtgcgcgcgcttgtggcgcacacgcaggccatcaaagcggacaacggacgcctgcggcaggagctgctgctgctgctccgccggacccagctgctgcaccacacgcggcgccagctgctggaacagcgcgagcaactgcaccgcgagcacgaggacacgcgggacctggcgcgtgtgcacggctggctgcgcaggggccccggaggcccgccgctctgggagcggccggccttctcccagcccacctcgcgccccgggtcattagccgcccccataagcccgtcgcgcgcggcctcccagaccccgtctgtggtaccgtcgcgcgcggccccccgggcctcgtccgtggtcccgtcgcgcgaggcttcccgggtcccctcgttggtgctatcgagcatggactccagggtcccatcgctggccacttcaaaggtgggatcccggatgccatccctgaccgcttcgcgcgcaggctcccgggccctgtcgctggtgcagtcactcgagggctctgggatctcttcggggtcctcaccgagggtgtcctcacaggacactctccgctccacgaagtctggccccaagcttctctctggcctgtcccgggatcgggatccggctcttctccccccacagtcggaggacagcgtgaacgctgaagctgcggcagaagcctccccgggtagagcctga

SEQ ID NO: 2493 - DNA, 7359 bp, Homo sapiens
atggcccagatccaaaaggataaagcaaatatttcagagaaaagtgtaatgcatcccgagtacatagctgtaaaggcagagaaatcacccctttcccatatactaaaaacaaaggaactgcaggtgaacatcagtcaacaaggggaaaaggcacaagaaggtgaggtggaaatagttgtacttctgagcaaaacttgtccttttgtcacttcttcagctttccttgagttagactcaataaaagaagaggaaggtgaaccacgaataacaagaagctttatgccacatcttgagatccaggaatcattgccttcaaggcaaacagcacctacaaagccaacagagagccttgtaaagaaagagaaacaactccttccacagaaagaagacagagtacaaacagtatccatgcatggcctgatgcaccccaatggtgccgttttcaaggcaaagacatcagcacctccacaagtgttcagcatcactgagcacagtcctctgagtaagagaaaggagccacagtggggcatgaaagagagagcaggacagaagcaggacaggacaggacgtcctcatgtgattctgacaaaaactcatccattcatgccttctctctctcaccatagattctctccttcacaaccaaagcttcctatatcatcaggtgcaggaaaaagcagacttgcaaattcaaatgaaggtattagctcacataaagtaatactaaaagcaaaccaacaaatgccatataaagaggcaaaggacagagtaaaaatagaaggcagggaaggtagaatactccccaaaaggatacatttgagggcagaggcactcccacttgcacttctatgcaatggaaagaactactctttgcacattgaagagcaaggggaaggagtacaggaaagcaaaaaggaacctggagtggttccgaggaaatctgcttcattccctcctcctccattttacctgaattgtgacactagaaggaatgaaaaggaaggcacattaggaaaaacacaattcagttttccaccactaaagattcaggattcatcagattcaggcaaaaaagcatatactgagtcactgcatggttacacattaagcaactcaaaaggaccagtgcaacccacagcacagggagaagagaaaggtggactcagaatagatatggaagacaaaatgctccccaaatgtacagacctgaaagcaaagcaattactactctcagatatactcaataccaaaaaattgcagtggaaaagtaaagaacaaaagagaaagattcaggaagataaaaataaacaagttaaaggactgccaagcattaatacttctttacttactccaccatatcttaagtttgatacaacagaaggacaggagaacgtgataagaattgcaaaagtgtctctcccacagtcacggtccaaggaatcatcagatgcagggagaatagcatgtccagaagcaacccatggagaactttcaagtgatgtaaagcaattaaaagcacacctgctacagaaagaagagaaggatagagaaaaagttgcggatatgaccagtgtactggatcccaacaaaatgtatttgaaggcaaagaaatcgcctgtcttacatacgcacagtttcagtgatcttcagtggaaaactagagagcaagaggaggaaaaggtccagaaagttaaaagtgggccaggtgtcatgttgtctaagagtccttctagatcctccccacttcaccttaatgtgaatacagggtttcaggaggaaagcataccaatattaacaagaccctcttttcccctagtaaaactccaggtatcaccagatactgagggaggcacatgtataaggccaattgctggtgatattttaatctatctacaaaaaggaaaacatgtgtcacagaacaaggaagaggatgacgtgcaaatagtaagcatcttaatattccccaaacatcaggaagagaaggtgcaggaatgtgaaggtgaaccaggtgtggttctgaccaaatctacttcattgccatctctatctcaactagaattggataaagaaacacatttaggtaatgaaatgctaagacttaaaagacctattttgcggagaatatcacacataggggagactgtacatagagagtccgtcgttggtgatatcccaaaagatgttaaaaatgaaaagcaacatatccctcaaaaagaagagaggaaccaaaaaaaaataatcgatatgagaggcacagatataactttgaagtcaaagaagtcacctcgttcctgtatgctccacagaacagaactgcatgtgaacattggagggcaaggacgaaaggaacatgaaggtcaagataaaccaccaggtatgattcaaagaaaaatgtgcatactcttttccaaacctttgccatctaaccttaaactggagagagctacgcatgcagatgaagaaaggcttggaggtaagacatcctttgtacttccactaatgccatcagcattaccagatacagagaaaacagcagatgcagaggcaaggagtggtgatgtaagaaaaggaaaaccacataggtcacagaaagaaaacaggcatgaagtgaaaacgatagatatgaggttcaggatacactgccaagaggcaaggatttcaccaatgtcacatatccttaatgcaaaggaattagtgttgaatattaacaaactggagaaaaaagtacacaaagataaagatgaagcatgtgtggttctgtcaaggacttttctttctataccgtcagcacctcctctttatctggattcagggaacaaaacagacaaagacactccaggaattacaggatcatcttgtccacagcgaactctccatgtaccctcaaatacccagaaaataacaaatagagactcagttgaaggcgttgataaaaacgttgttaagcaagcagaacagtatgtgccccgcccagaggcagagcaacagttgacctcaaacttcatgatcagcgtccagcaaaggaaccaaccttcacgagtcaggtcagaagaagatttgaatcagttagttttaaactcacgggatgaggacatttatttcacagggtttggtaccataagaagtgggaaaaggccggaatggctctttacagggaaaaaggctcagcctgtaaaatacaaaacagaaactttaactgcgtttctttcctatcccacaatggatgcaactaaaatgggaggtctggaagaagacactgaaataatggataacttaaaccataaaatcagtcctaaggcttcagtttcactgataaggaaaatatctaaggaactgtatgtcacacttggcacccctgcaaattcaaaaggattttctgtttcagagagatacgctcaccagcaagaaacttcatcgaaagtatctccagaacttgcaggttcatgtaaatttgataagccaaaggaagatggacaaagtaatgatagaatcagcaaaatgttttctcccaaagtgttagcaccacagacaaagggatcactcaaaaaaataagtatcgtcaccaactggaatgccccccaaaatatagaagaacaagatattgtcatgaaaaagcaagtgatccgacggtgtgaacatgggcacaagaccaggacgaacactatcctttctaagtttccccttcaaagtggaaagcagaagacaccatcggaaacagatgtggacaagaaaacaacagcgcacctcagcctacagatgctaccaggaatacacatggatatgacagagattgaccctgcaaaagggggaaggaagcaggcattgctcatttcagaacaagaggaaggtgttctggaatttcttccgaagtccctattccctccctggacttttcaatttcaatcaggggatctggaggaaaaacatcaaacagacgcaaacaccaatataaatctagagcagaaaaaattagaaatggacaatgatagtactgtgaatcagaaagaagggaaattaaaaataggcacaaacagagctttacatctgcaagaagagaaaacagagatgcacaaggccaggactgccaatctggagaaggagagaggaagaatggacacaagcagtagtgcacacccgcatcttctatctctaaaggcagaggaatctcaaatgaagactcaagtcatcactcatagggagaacagccgcctaatcatgcaaaagcagaaaaaagaactagaagcatctaatgcaaaacaaagcattcaactacaaaaattatttcaaagaaatgttctggattcattttattcatatgttcctctttctcccaaacgtaaagatcagaaaggcagattaacaataagagatctgaaaagagaattgagcaccaaatatttaactatgaaaatccagaatcacccaattccacagatgcttaatatcacggggcgtggtacaccaagcaatagaaagaaattagagtatgatgttaagttaaagaacatagcttcgtggagtaaagatgtctcaggaatatttatcagaagtctttctatttccatcatgcgttcacctcacactgaccctaagacaaacctagaaagagaaaagagaatctgtcttcctaaattccaggaaaaatcaccaaacactagtgaaatgtctaagagagacactttaacaattgtaaaaggggaacagaattttacaaacacagttccacaagatccccagccctttgcagtggacaaacaacaaatgcagaaacttcctaatgtcaaatcagaagcaaacctcagaagtgaaatgaataaaaaatacttaaaggcacaaacaaaagaacggattgttccagagcatgatgtctcaaggatcattaaaaaaccagacttacgtatcatcgagcaggaagaaaagattctaaaacgcattctgacacccacagagtgtccatctatgcttgaagatccaaagttacccaagcaaagggatcagagtgaaccagtatgggacatgaccacacaaaaggttcagcagcaaaaagctttcccaggaactgtgcccataccgcctcaagttaaaagtagcgaagtcaaaatagttgcagacagtacaaatgcagaacatttacttcccatttgtgaagcaaccaaagctatctctgagtcccaggttaaaaatatgatccaagacaaagtttcttctgataaactagataacatacaagcctataagcctgacgacttgaagtcaccaccttttccagagggtccagatacaatatcaacagcaatatatcccaaaacgcagcacaaatcccttttagaacagtttactcccaaagaaaaaaataagcttactagtcatttagagtcaaaagcacttgaaatacaactgaatctgataccagagatggcaaggaaatctttacaaatgttcaacttttatccaaaagggactatttcaaaagataacagttggaggttctattctagacataaaacaatgaactttatgtctctagaagggactgataccatagaacctaactcaaaacataaacaccaaaaggattcacctcttgccagcaatatgaagacactgattgttgatgtttcaagtgacagtgaggagacaatcacaaagctacagagtattaataagctagaaaatggaacatctgcagtgacttctgctagtgagatgctattgcctcataccctccaaaaccactcagtaaaagaaaaaggcaaactcctcatgcacttttctgtgaaaacattggagatacaaatgaaagcctttcccagaattgtaagagaatcttatgcaatgaccagtgctcatgagagaaagaaacccttatctaactgtattcatcctggtttcacaggaccaaaacgacaaaacagaattttgttactttctgaggagaaatctctccatcaaatagatcttgatttacaatacaaataccttcgttttctcctggggcttcctgttggaagtacgttccctaagccaaatgtacttcccaaacatagtaagttaaacacaattgcagtgtgtaaaaacgtaaatgctggtggacaaagtggtagtctttccattgatacagaactgttagaacaacatatttctttcaaaaagcaaagtccccatgaaaactcatcactcatcagaaaattcccacagccaacccttgtgtgtgcttctgaccgtgatctgcacagcccgaggaagaaagatactcaagttctttcagagtcagaattccatgtgactccagaaaaaaacaaacaatatcatgtatggtttcaagaaagaaatacatgtgaatctgttgatttaaggacccagagaaatgctactggttcagctgtttcatgtgaaactcagatttctgaagattttgttgatattcagacagatattgagagtccagctgacttggacgagtgttcatgtcttgaagtaagtgagagtgaggaatgtgtgtttctggaagccaactcttatttaagtcaggaatcagaaaacattctatttgaattacagacaggcattcctttggaaaatgtctacaaaatcacgactgatttgaaatcattttacagtgaagattcaggttcccattgtactagagagtgcagaaaggaaaccttaattattacaccaccttcctgtaagtcccacaaaagcaggaaatatagatcatcttccaaaatgaaatctcctgactggttgtgtcatagttcatcaaatactgcggaaattcagtctaggtcatctagtgtatcattcagtgaagagaagatttcatggactaccaagagcagaacaagttactcttcagctcccttaactgaatcaaatattaaatcacatcttgcaaaaaaccaaggcaagtctcacaggcacccagaaagccaagaaagaaagaaggccagatctgatttatttaggaagaacagcagtcattgggaccacgattacagttgtacacacagcaaagggaaacgtgacagaaagaagagagtgtatgattatgagtcagaaagattggattgtttccaaagcaaacataaatcagcatcaaaacctcatcatgacgatatcaacttctattctgaaagaaaacaaaaccggccctttttttttgcctgtgtaccggcagactcactggaggttatacccaaaaccattcgctggactattccccctgaaaccttaaggaaaagaaacttcagaattcccctagtggcaaagatttcaagttcttggaatatatggagttcctccaaaaagttgttggggtcgctctcggggtcccttactaccgtttttcatagctga

SEQ ID NO: 2494 - DNA, 708 bp, Homo sapiens
ggaaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcc

SEQ ID NO: 2495 - DNA, 716 bp, Homo sapiens
aaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcaggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 2496 - DNA, 624 bp, Homo sapiens
ggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcc

SEQ ID NO: 2497 - DNA, 832 bp, Homo sapiens
gttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 2498 - DNA, 753 bp, Homo sapiens
aaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 2499 - DNA, 1088 bp, Homo sapiens
gttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcctttttttttccatttataatattcaagttataaagttaatggtcagcacatttcttcagggaataaaatagataagaactgccacatttttctttagttccttttccagacgtgtgttcctttgtctgcataaaagtaattttctccagtgaccctaaactatgtaatagaagtgcttgagagttttaaaatatcctagggaatctgaaggctggcatcattacacttgctttcaataatatacccatgatctgctctgatagtaacgttgctattctatttggtttctagttgactgttagcaaaaagtgtgtattcataaaacctttttgccattttgggctggatcttgctcagttttttaaattgcaggtttaaacaaagccg

SEQ ID NO: 2500 - DNA, 837 bp, Homo sapiens
aaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 2501 - DNA, 2151 bp, Homo sapiens
aaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggtgcagtggctgcggctatccctacaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagtccttaacttttctgtacctcttctgtttttgtaaaacagattaaggattaaatgagtttgtcaggt

SEQ ID NO: 2502 - DNA, 443 bp, Homo sapiens
ccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggccta

SEQ ID NO: 2503 - DNA, 2216 bp, Homo sapiens
aaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggttgtgccacaagaacaccagggcgtgccacaagaaccccagggcctcccagaccagcaggccagtagatctgctctaaagaggttaacagaggaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagtccttaacttttctgtacctcttctgtttttgtaaaacagattaaggattaaatgagtttgtcaggt

SEQ ID NO: 2504 - DNA, 2181 bp, Homo sapiens
aaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggttgtgccacaagaacaccagggcgtgccacaagaaccccagggcctcccagaccagcaggccagtagatctgctctaaagaggttaacagaggaggtgcagtggctgcggctatccctacaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagt

SEQ ID NO: 2505 - DNA, 4650 bp, Homo sapiens
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccaaaaacgggaagtacttgagaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaa

SEQ ID NO: 2506 - DNA, 4526 bp, Homo sapiens
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatgcttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaa

SEQ ID NO: 2507 - DNA, 4552 bp, Homo sapiens
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatatttta

SEQ ID NO: 2508 - DNA, 4658 bp, Homo sapiens
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaa

SEQ ID NO: 2509 - DNA, 658 bp, Homo sapiens
ctcccggaggcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaacacacacaaaaaacactttttctattgtttgagaaaaatcagtgtttctcatgaaactctatatcttctccaaaaatacaaataaaatactaataaaa

SEQ ID NO: 2510 - DNA, 650 bp, Homo sapiens
aaaactaaggctcaaagtggggaggagacttgcccagggacacccagcgagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggtttttttaaaaaaaaaaaaaaaacacacacaaaaaacactttttctattgtttgagaaaaatcagtgtttctcatgaaactctatatcttctccaaaaatacaaataaaatactaataaaatgtt

SEQ ID NO: 2511 - DNA, 494 bp, Homo sapiens
gtccagtggtcgggggaaggcgaggattaccctcccggaggcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagaagacatttgtggataaatctgaactcacttcctgtgtgtaacttctaacttcactggttcctcccatctgaattggccacatgcttgctgaagagacttgttttcttcttctaagacagtggttttgttttttgggttttttt

SEQ ID NO: 2512 - DNA, 1463 bp, Homo sapiens
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagcagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggactttaaaa

SEQ ID NO: 2513 - DNA, 3619 bp, Homo sapiens
gggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcatgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcactttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtag

SEQ ID NO: 2514 - DNA, 1022 bp, Homo sapiens
agttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctg

SEQ ID NO: 2515 - DNA, 2176 bp, Homo sapiens
gtgatgccaccactgctcccaggagcccacaggacctggagctctggaagctgatctcctcccactgcaccagccagcaggttcatgttcgaggccatcttcccctccacaccccaagccaggctgaagagagatccacgggaaaagccgggcctgtcctcattcaggtccacattcaggcaacaaagctcacttggtctttgcatcccacgcctcatgttacctaaggaggccagcccatctcagaggcacagttcgatgtccagctcgatggccagggccctggtgctcctccagagcatggccagccgggacgcccggtgcccagaatggaaaccgcaccaaaagccacgcacgctcagcaagtcggtccagaccatcagccgctactacaggaagacgagtgaacccaaggatgccgccagcctcaccggcttcatgtccaaaatggaacttcgaagggtcttccccacgcatcctgactgcccccagttcagcaccagggccacatccatgtcccactgtggttcacccactgaggccgatttgtccggagagattgacaacagctcggagacctggagaggcacccaggacctgttcttggccaggcggggctcagacacgaacgtggacgggtacctccttcccttcagtaagagcatctgcgagttcgattacttgcggaagaggagaaaatcccagactttgagtccggtcaccagcagctcagtcgcatctcagagctgcctgagaaagaggatgccctggtacctctcagtcatccacgagaaggatcactgcctgtctgagctggagatacaggttcagaagaaagacgaggagatcctgctgctccaggaggagagggaggccctgaagatgcagctgaaatgccttctgaaaggcaaaggccaagagacatccatgtccccaggcaggagggagcagctctcagacgcttcgctgaagctgggcaggctgagcctcctgaaggccttctccagacatgaggaggagctgcagcactggtggcagatgcaggaggagtctgcggcaccggagaggggcaaggagcccgacctgggaggtggcgaggaggacgagggcctggaaggggagcccgatggggtggaggacacgggtgcctggggaggtgtgagccagatgggatccgtgcatgaggagggaagcgaggaggaggaagaggaggaaggggacagggatgaggactcagaggaaagggagctgccggaggaagaggagatccccaggagaagggcctcctccctggccgagtcgtttgaggaggagctgctggcccagctggaggagtacgagcaggtcatcctggacttccagttcaacctggaggccaccaggaccagatactcccttgcaacaggagtgattgcgtctttacaacaacaagtggatttccaagaaacccagctgcgaaagatcaatacggaaaatgagacgctgcagaaggagctccgagagcggaggcagcagctacaagccatgaccgacaagttctccaacctccgagaagataagaaacaccaagagatgatggggctcattgaaaaggacaaccagctcctccgacagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccaggctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgt

SEQ ID NO: 2516 - DNA, 1226 bp, Homo sapiens
cggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaatt

SEQ ID NO: 2517 - DNA, 1496 bp, Homo sapiens
ggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 2518 - DNA, 2600 bp, Homo sapiens
gagctgttacaccatctccagagtcgttggtggctacccatgctaagtcattagtcctctttgcttactgctggctggcagatcctgaaaatgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaa

SEQ ID NO: 2519 - DNA, 3098 bp, Homo sapiens
attgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaatggatttctcaagtttgtttgatatcctcagatgccttgtattgaccaaaatattgactttagttcaatgatttatttaggtttctcttcagcagagcacatgtagggttaattcaacattctttcccattatcatgggtatcttttctgatttattttttaacagtaaaaacaatacagtcacattaaagcaaattttgtttttaaaaaaaccctcctatgctgggcgtggtggctcacgcctataatcccagcactttgggaggctgaggtgggtggatcacgaggtcaggagatcgagaccatcctggctaacacggtgaaaccctgtctctactaaaaatacaaaaaaattaaccgagtgtggtggcgggtgcctgtagtcccagctactcagaaggctgaggcaggagaatggcgtgaacctgcgatagcaccactgcactccagcctgggtgacagagtgagactccgtctc

SEQ ID NO: 2520 - DNA, 1872 bp, Homo sapiens
atgatccacccgcctcggcctcccaaagtgctgggattacagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgt

SEQ ID NO: 2521 - DNA, 3648 bp, Homo sapiens
gggacgctcgcggcaccctccgcaggaaaatttccgacttggttcttgaggttcctgcctcagccccaaggaggaaagcacccattctcccctcttttccgcattacgggccttttctgcttctccccagtatggtccgaaactacaggaggggaacccctcctggcccggcctttctattccctggctggagtgattccgcctgaaggagaattcgcccgttttccccggacccagctgccacaagcatttagtattaggctgccgcttattattagagcgggcttagaacatcctcagcgagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagttggagtgctggagtgcagtagcatgatctccgttcactgcagcctcaacctcctgggctcaagtaatcctcctgtcttgtcctcccaaaatgctggaattacagtatcataatgaagacctggaaaaagacaaaacatcacaaaactgcctaggaagaggaatggaacaagtagcaaagaagttaggggtggctcatgaagagattcaaaggctcactgatgaactacaagtgaaggagaaggaacaatgtaaattagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgt

SEQ ID NO: 2522 - DNA, 396 bp, Homo sapiens
tcctctttgcttactgctggctggcaggtgagcagtgctgctaagctgacatgattcttgactacatcttttgtccataccactggacaggaggaattataaaagttacactaggattttagtatccatttttctaatagcattccccattctttctaactcatcagctttggattgttatttctgttttattgacattaaacataagaaaggtttttttacataacagaaaattcactttggcaaggctgaatagagtagatattaaaaatcctgaaaatgagccaagaaaaaaatgaaatgtttgaaagtgagtggtcaaaagagagagagagagagaagcagttggcatctggtcttgacactgcagagaaggccttgaaagttgaaagtgag

SEQ ID NO: 2523 - DNA, 2093 bp, Homo sapiens
caggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtggaccccggggagttgggagcaggaggagacttgacagagaggctacaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtga

SEQ ID NO: 2524 - DNA, 3085 bp, Homo sapiens
atggcattcagggggcctgaaccctgggtctctgcatccctgctgagacagaggctgaaggccgaggagaagacgctggatctggagttcgaagttttgagcgtggggtttaatgaggcgggtagatacgccctgagactgtcagcagagaaccccctgcaggtgggctctggggctggggtgcagttgcaagtgaatgatggggaccccttccctgcctgctctgctatcactgatgtcattgagcagcaggagcctggccagagcctcaccctcaccaggagcaagtttatctttactttgcccaaaggtttctgcaagaatgacgggcagcatgatgctcagctgcatgtggaggcactgaggctggacgaacccttgggacgggcagcccagcgggtgggtgaggccatcttccccatctacccgaggccagaccaaccccgcatgaacccaaaggctcaggatcacgaggacctgtaccgctactgtggcaacctggctctgctccgggctagcacggaccccacagcccgacactgtgggagcctggcctacagtgtggccttccacgtccaccggggccctcagcctccagtctcagacagccctcccagggctggccagccagaactgatatcacctgaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgaaaagcacatctgaggaaaagaacaatcagagctccaaggcagtcacatctgtgacctcagagcccaccagagcccctatctggggggacacggtgaatgtggagatccaagctgaggatgcagggcaagaagatgtgatcctcaaggtggtggacaacagaaagaaacaggagttgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctcgcgtcagccagaacggatgccctcagctgtccaagcctgggggacccccagagcagcccctgtggaatcagtccttcctcttccaaggccgagatggagctaccagcttctcagaagacacagccctggtgctggagtactactcctcaacttcaatgaaaggcagccagccgtggaccctcaaccagcccctgggcatctctgtgttgccgctaaagagccgtttgtaccagaagatgctgacagggaaaggcttggacgggcttcacgtggagcggctccccatcatggacaccagcctgaaaactatcaatgatgaggcccccacagtggctctctccttccagctgctttcctctgagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtggaccccggggagttgggagcaggaggagacttgacagagaggctacaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttctttc

SEQ ID NO: 2525 - DNA, 2673 bp, Homo sapiens
ttgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgaaaagcacatctgaggaaaagaacaatcagagctccaaggcagtcacatctgtgacctcagagcccaccagagcccctatctggggggacacggtgaatgtggagatccaagctgaggatgcagggcaagaagatgtgatcctcaaggtggtggacaacagaaagaaacaggagttgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctcgcgtcagccagaacggatgccctcagctgtccaagcctgggggacccccagagcagcccctgtggaatcagtccttcctcttccaaggccgagatggagctaccagcttctcagaagacacagccctggtgctggagtactactcctcaacttcaatgaaaggcagccagccgtggaccctcaaccagcccctgggcatctctgtgttgccgctaaagagccgtttgtaccagaagatgctgacagggaaaggcttggacgggcttcacgtggagcggctccccatcatggacaccagcctgaaaactatcaatgatgaggcccccacagtggctctctccttccagctgctttcctctgagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtg

SEQ ID NO: 2526 - DNA, 1993 bp, Homo sapiens
atcctggggaacaggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgta

SEQ ID NO: 2527 - DNA, 2613 bp, Homo sapiens
gcttttccttcatctccaaagtcctctaaactgacagggtctcattctgtcgcccaggctggagtgtagtgacgcgatctcggctcactgcaacctctacctcccaggttcaaacgatcctcccgcctcagcctccgagtagctgggaccacaggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccagggcctccttgttctggtcatacacagtggagtgtaggtcgagcgacaagtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcagga

SEQ ID NO: 2528 - DNA, 2547 bp, Homo sapiens
atggccagagtggacgccaaggccaaggaagctccgagagcaagcgagggctgccagcatgctgtcacctctcagaggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcaggatttttttctttcttatttttagccacttatgctaccagaatgtttgcattttttgatcagtagacatattacaggacaccctaaatcttcttgtgaacagagaaaataaaatgataagcctgccagtgaaagaggtgacattcactagcaaatgtccagagcatatcactgctcacaagccatttttcttcctggttgctttttcccttgtcctgtttttcaagcactttcttaaaactaataatattgtagaccttgtatttctgaagagcagtgggcttatatgggactttggctttccatttttatcttgctgaagtttttgagtttttgcaacacaagtattttttgttatcagaaataagataaaacatttaaaag

SEQ ID NO: 2529 - DNA, 1568 bp, Homo sapiens
ggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgcccccttaggagttagaaatactgtagtacctgctgctcttcttgctgccttggtttcagtgagagctgtgttgtgaatcacagcatcattctcaattttttttttttttttgagacagagtctcgctctgtcacccaggctggagtgcagtggcgcaatctcggctcactgcaagctccgcctcccgggttcacgccattctcctgcctcagcctcctaagtagctgggactacaggcgtctgccaccacggctggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttacacaaa

SEQ ID NO: 2530 - DNA, 2843 bp, Homo sapiens
caggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccagggcctccttgttctggtcatacacagtggagtgtaggtcgagcgacaagtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcaggatttttttctttcttatttttagccacttatgctaccagaatgtttgcattttttgatcagtagacatattacaggacaccctaaatcttcttgtgaacagagaaaataaaatgataagcctgccagtgaaagaggtgacattcactagcaaatgtccagagcatatcactgctcacaagccatttttcttcctggttgctttttcccttgtcctgtttttcaagcactttcttaaaactaataatattgtagaccttgtatttctgaagagcagtgggcttatatgggactttggctttccatttttatcttgctgaagtttttgagtttttgcaacacaagtattttttgttatcagaaataagataaaacatttaaaag

SEQ ID NO: 2531 - DNA, 1454 bp, Homo sapiens
atgctctccactccgaagagtcaggggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgcccccttaggagttagaaatactgtagtacctgctgctcttcttgctgccttggtttcagtgagagctgtgttgtgaatcacagcatcattctcaattttttttttttttttgagacagagtctcgctctgtcacccaggctggagtgcagtggcgcaatctcggctcactgcaagctccgcctcccgggttcacgccattctcctgcctcagcctcctaagtagctgggactacaggcgtctgccaccacggctggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttac

SEQ ID NO: 2532 - DNA, 2315 bp, Homo sapiens
agaggcagcgggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcagga

SEQ ID NO: 2533 - DNA, 2086 bp, Homo sapiens
agcgcggaggcttcggagcgagccggggcagtcggggtcggtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgaacggcagcagcagaagacgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagaaaagaatgtggagcctgagaacatgagtggctacattaagcagaagcggcaaatgttcctcctccagtatgccctggatgtcaagcggagagagatccagcggctggagacgctggcgaccaaagaggaggccaggctggagcgggccgagaaatccctggagaaggacgccgccttgttcgacgagttcgtcagggagaatgactgcagctccgtgcaggccatgagagcggctgagaaggagaccaaagccaagatagagaagatccttgagatccgggacctcaccacccagattgttaatatcaaaagtgagatctccagatttgaagacactctgaagcattacaaggtctataaggatttcctatacaagctgtcgcccaaggagtggcttgaagaacaggaaaagaaacactcgtttctcaaaaaggccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtcgaactctcccatcccccccacgcaggaggacaccgacagcgatggggaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatggacagggaggtcaaccagctgaagcagtgggtcaccacaatgatgatgtccatcaccaaggaggaggacacagcagctgagctggagctcaaagcccgagtcttccacttcggcgagtacaagggcgatcagcaggataagctgctagagagcctgaactgcaaggtgctggatgtgtaccggcactgcaccggcacccagcaggaggccaacctgggcaccgtgcagatgctgaccatcattgagcaccagctggatgagctgctagagaacctggagcacgtgccccaggtcaagatcgagcaggccgagagggcaaaggagaaggagcggcgcatcagacttcgagaagagaagctccagatgcaaaagatcctacaggaggagcatctgcagcgggcccgggcgcgcgcccaggctgagatcaagaagaagagaggcaggacactggtatgccgctcacgacccccagcccacaggatcaaacaacagtctgagcacacactgatggacaaggaggaggaggagctgctatttttctttacttaatcttcgcagaccatagctgttctggctgaaggcttagcaaagatgttggcagaggaagcagagactgggctgggtctcgagtggcccaactgagtcctctctgtctcctgtgtgctcccttcctcacctgaataaattcatgtctctctgg

SEQ ID NO: 2534 - DNA, 2089 bp, Homo sapiens
agcgcggaggcttcggagcgagccggggcagtcggggtcggtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgaacggcagcagcagaagacgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagcagaaaagaatgtggagcctgagaacatgagtggctacattaagcagaagcggcaaatgttcctcctccagtatgccctggatgtcaagcggagagagatccagcggctggagacgctggcgaccaaagaggaggccaggctggagcgggccgagaaatccctggagaaggacgccgccttgttcgacgagttcgtcagggagaatgactgcagctccgtgcaggccatgagagcggctgagaaggagaccaaagccaagatagagaagatccttgagatccgggacctcaccacccagattgttaatatcaaaagtgagatctccagatttgaagacactctgaagcattacaaggtctataaggatttcctatacaagctgtcgcccaaggagtggcttgaagaacaggaaaagaaacactcgtttctcaaaaaggccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtcgaactctcccatcccccccacgcaggaggacaccgacagcgatggggaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatggacagggaggtcaaccagctgaagcagtgggtcaccacaatgatgatgtccatcaccaaggaggaggacacagcagctgagctggagctcaaagcccgagtcttccacttcggcgagtacaagggcgatcagcaggataagctgctagagagcctgaactgcaaggtgctggatgtgtaccggcactgcaccggcacccagcaggaggccaacctgggcaccgtgcagatgctgaccatcattgagcaccagctggatgagctgctagagaacctggagcacgtgccccaggtcaagatcgagcaggccgagagggcaaaggagaaggagcggcgcatcagacttcgagaagagaagctccagatgcaaaagatcctacaggaggagcatctgcagcgggcccgggcgcgcgcccaggctgagatcaagaagaagagaggcaggacactggtatgccgctcacgacccccagcccacaggatcaaacaacagtctgagcacacactgatggacaaggaggaggaggagctgctatttttctttacttaatcttcgcagaccatagctgttctggctgaaggcttagcaaagatgttggcagaggaagcagagactgggctgggtctcgagtggcccaactgagtcctctctgtctcctgtgtgctcccttcctcacctgaataaattcatgtctctctgg

SEQ ID NO: 2535 - DNA, 2277 bp, Homo sapiens
agagccccggaaggggggccatgggggaaacctctgcccggggggttggggtgggagcctggagatagcgctcctggagagggcagagtaggggaaagctgtgcccaggggcagggacgggagcttggaggtagagccccgggagaggacagagtgggggaaacctctgcctagggtgctgggacgcgagcctggaggcagagccccgggagggtactgcgtggaggaaacatctgcccacaggttctggggcgggagcccgggacgcggagggccgcgagccgagggaacctgggggtggggaggagggggatgcggtaggggaggtgctcctgggtccgcgcgggtggcgggtgccccgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggtaaagtaaaagatggctcaaccaaagaggacaggccttataagatctttttcagagatctctttcttgtcaaagaaaatgaaatggcagcaaaggaaacggaaaaatttatgaaccgtaacatgaaagtctaccagaaaactactttttcatccagaatgaagagtcattcatacctgagccaactagctttctaccctaaaaggagtggtaggtcatttgaaaagtttgggccaggtcctgctccgattcctagattaatagaaggttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattacc

SEQ ID NO: 2536 - DNA, 3130 bp, Homo sapiens
gagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaa

SEQ ID NO: 2537 - DNA, 2339 bp, Homo sapiens
gggtgggacttcctgcttcgcgtgccgctgggccaagggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagcttgaacaggatcttgagttgggatgcccttctgtgactgatacatacagagagagtgtattccccccacccccattgaagagagatctcttgaagtga

SEQ ID NO: 2538 - DNA, 3183 bp, Homo sapiens
gggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttt

SEQ ID NO: 2539 - DNA, 644 bp, Homo sapiens
gggtgggacttcctgcttcgcgtgccgctgggccaagggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaagagccagctttagagtttgcccctctgcttatgaaatccctatggaaaaaaggtataatttggcttcctgagattctgccttagcaagaaaggagtgggaaatacccttggaaagaaaactaaaacagtaagaaagccaaaacttatttttacatggttg

SEQ ID NO: 2540 - DNA, 1380 bp, Homo sapiens
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccccatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgagttcgaggagatccatgaggtgattgcacgctacaagacgctggtgagcatgcgccacgacctcatgcagtctgcgcaggaaggccaggagaagattgagcgcgccaaggcccggctggcgcgctacatggaggaaaaggatgatgagatcctgcagcaaaacaatgagctggcaaggctgcagatgcgctttgaccgtgcccgcagcaatgtcatcttctgggaatctcgctgggcgcacatccagaacaccgcagccaagaagaccctcctgcttggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttctctcta

SEQ ID NO: 2541 - DNA, 1158 bp, Homo sapiens
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccccatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgaggaatctcgctgggcgcacatccagaacaccgcagccaagaagaccctcctgcttggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttctctcta

SEQ ID NO: 2542 - DNA, 1514 bp, Homo sapiens
atggcggtgccctgggaggaatatttccgactggctttgcaagagaaactgtctacaaagctgccagagcaggctgaggatcatgtcccaccagtactgcgtctcctggagaagaggcaagagctggtagatgcagaccaggccctgcaggcccagaaggaggtgttccgcaccaagacggcagccctgaaacagcgttgggaacagctggaacaaaaggagcgggagctaaagggatcgttcatccgctttgacaagtttttgcaggactccgaggcccggcgcaatcgcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccgggttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgtgaagctgttcatgcaggacctctctgccatgctggccggcctgggtcaggctgagcctgcagcccctgcctcctagccctgacacaggctgacgcagctgctgcccttctgtggccatacagtgctccttttcacagatgatggctcctgcagggagtgcccccagtgcccagcacagggccaggcacacagtggtgcacgggaacgtctgctgatgcccaccctaaggccaatcaaggagccacggggctgggtcctggtcctcacatcctcttccgcatcttgcccttcttggagcgggcaccccggccgaaggcgccctgctgcagctcctggacgcggcggcggttgcgggcagagagctgcttgaggccaccacgctgcaggaagtgcagcttctgggcccggcgccgctgcttcaggatctgctgcttggtcttgagttccgggcggactcggcctgcaggggtgcctggggcgtggggccgggatgcacctgctgggacagggattcagggagctcagctgttgggatcactcccaagatcccctcctcccagaagcttgcagactcctcccctgcccctactcctgttctgtgcttattgctgtggcccagtgtctgtacacagtaggtggctaataaagttttaggcagcctca

SEQ ID NO: 2543 - DNA, 2138 bp, Homo sapiens
actgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgctgt

SEQ ID NO: 2544 - DNA, 2079 bp, Homo sapiens
actgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggattctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgctgt

SEQ ID NO: 2545 - DNA, 2691 bp, Homo sapiens
atggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtcggactctggaagagccaggcgagcacccacgagatggggcacggcgggccggaggctgcggtgcgggagctgcgtcaggcgcagggcgccctggctgcggcggaggcccgcgctgggcggctgcgccgtggccaggccgaggtgcggcggcgcgcggaggaggcccggcaggtggtgctgcgcagcctgcaccgcgtgcgagagctggaggcgctggcgcaacaggtgcccggcttgcagcgctgggtgcggcggctggaggcggagctgcaacgctacaggtcagaggattcccagctcccaaccccgcagctagccaacccagagccaggagacaagagtaatgaacctgaagatgctgggaccagagacccagaccccactccagagggagcctggcagtcagacagcagctctggaagcagagccctggatgaagtggacgagcagctgttccgctccgtggagggccaggccgcctctgacgaggaggaggtggaggaggagaggtggcaggaggagaagaagacgccggcagccgaggccaagacactgctggcccggctctccagctgcagaggcaggtgtgatgaccagacggcggagaagctcatgacttactttggtcacttcggcggtgccaaccatgcccataccctgggggagctggaggcctgcattgccatgctggtggagcagctgaggactcagggctgcggtgggaggaccctggggacctctgaggaggaggcagagttgcagcagaaggtggaagagaatgagcacctgaggctggagctgcagatggtagagaccgagagggtgcggctgtccctgctggaggagaagctggtggacgtgctgcagctcctgcagaggctccgggacctgaacatatcgaaaagagccctggggaagattttgctgagcacgctggacgctttcagggaccccacccacgagggaaggcccagccctgcagccatcctggatgccctgcaccaagccttggctgcctgccagctgttgcggagacagccctcggcaccagcctctgcagcagctgcgctcaccaaccccctcctcgtctcctgctgaggttactggcccaccctgtgggcaccctgctcagcctgactgcctttggaccagcctccatgatcagcccaaccactgacagctggtctgaccaccgtcacatcatcagaacttgagtctctgctggctccttccaaggttaagcccgagcccagagcctcccattgcagcacctggcagccaccccttcctcgggctcctccacattacctcgcagcccctgcattcctgccaccagagtccacattaaagccctgcagttgctggatcagcctgcacctgatgctgtatctttcccctgccctcagggcagagatgcccactttctgactgagtctgaccccaaatctcttccccagagtttcaggatctcctcccctcccagcactgtctccttcctcccactggcatgcctgctgcaacggagactgggcccaacctttgggatacctggtctgtaggaaagcactccacaccccaggaaatgttgatgactaggaaaggctgagggaattccaaggaaggaacaatcactgtaggctccctggtagaagctggccttgaaccagctctagaggacaggtaggatttagacaggtaaagaaaggagggaagggcatagaatctaaggtaatggcaagagcaaaggtgtggaaccagaggggggccccaggaatgcagtgcttggagcccctgctcctgaacacgcattaactcctgaactgcgagcccctcctcctgaactgcgtcatggggttgcaggaaggagtaggccaagatacccagtctcacctaacttagactgtcattagagagaaagatccattgccaaacagtgccatgggggtgaaaccagtgctaaatggaggtaaaataaagtttgtaagagcccaa

SEQ ID NO: 2546 - DNA, 1294 bp, Homo sapiens
aatgattaccatatgaaagattccatgcagttgactattatttcacagagctctctggttgggctgctctataagaagctaatcacctaacagtgtctattgctgtggctgatgatttccagagtgttctaagatgttatcaggaaaggcatccaacaaatagtaagagaaggaccatttcatttgtacattatttcttcctgtgattctgttttccaacaccttgcctcttgtttcaccatgaaagatgtacacacttcacaccaaaagggtaaaagctgctgctaggcagatgtggacttcaaatctctccaaggtcagacagtctcttaaaaatgtttaccacaaatgtaagattcggcaccaagattcaactggatatcccactgtgacatctgatgattgtaatcaagatgatgatagttatgacggaaaaatgaatcttccagtagtgctccaagatgttaaaactgctcaagttgaacttttcagccaaatgactgacattgtccatatgataccaaaagtccaggaaaagactgacttgtatcaaaaacagatggaggtcctggaaaccagaatgaatgttaatgaagacaaacaatgcacaacgactaaagatatcctctctatgaaagaagacatcaaggcattaaagaagaaggtgacagaactggaaattcagaattcctgctccacgatacattgtctagagattctggagggagaaaggggtaaagaaatcacagaactgctttacaaactcatacaaccagcaactctgaagaacactttggcctctacagacatggaaatctcttcagcagaaccagagaaagtgcccagttatccaaagtccactgaccatcttgagaaaaaaacaatttctccccaaatgaaaactctgaagaaacgtaaccatcaaaatgcatcaaggagctttgaaaaagcaaagccaaatatttacatttacccagacttcagtacatggatcaagctaacttttgttcatggaggaaaatggacatttttcctcagtgctaccaagttagaagaattcatccagtggcttctttctaggccaaccattcttcctgaggaaccccaggtcataacccagagatactgtccattcactgggcccattttgagcttgaccacaatctgtctctccatcttcaacaatatttacggctttatttgttccttaaaagaagaagtaactcgactatagagttatgttctgctttgcttggcacaaaataaatgtaacctggaggctccaagtattcac

SEQ ID NO: 2547 - DNA, 2272 bp, Homo sapiens
agcagctcatcgagatggggaacaggctccgtgcagagctgggccgacccgaaaggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagaaatggggtctcactatgtcacccaggctggtctcgaactcctgggctcaagcagtcctgccgccttggcctcccaaagtgctgagatgacaggtgtgggccccacgcccagcctggcgtggagtggagcccttcacccaaacatgaaccaggaggcgagcttggtaaggagcacgtgggctccaggaatgcgagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcaggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtcttggaactttctgagaaacagatggtcaagtagatgtctgttagctcttttcttgaaattgtagtgacgaaaccatgactgccacttaggaaagtaacttgtgttgaaataacttttagaacaaagtaaatacattaagaaataaccaaatcggcttactttctgataatatttattctatgcccacacaacggctggcactcacttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaaggtgaaccctggggccctggccttctgcctgaaggccgtttctgggctgccggcacagggagggaagcagggcctgagcaaagctgagcacccttacggagctgagactgcactagggtctggggacacagaaggagccggcatttcagggcagaatcccgcaaggaggaaactgcagaaaagagctccagaaatctgcacagggttctcttgagtctgtactgaggaccagcctgtacatgtatagaagaaaactccacaaagccaggcaaagaggagaaaggagcatgtaaggtgaacaacttccagacctcgcacacggtcatgacatactgaagctccagccagggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtaatcccagaactttgggaagccgaggtgggcagatcacctgaggccaggagttcacaaccagcctggtcaacttggtaaaaccccgtctctactaaaaatacaaaaattagtcaggtgtggtggtgcatgcctgtaatcccaactactcaggaggctgaggcatgagaatcacttgaacctgggaagcagaggttgcagtgagccgagatcgcgccactgcactctagcctgagtgacagagcagactcctgtctc

SEQ ID NO: 2548 - DNA, 3000 bp, Homo sapiens
cctggccagcgctgctggcgggcgttaggcggccaccatgctgccactgggctcagagcccgccctgaatgagctgctgcttcgcaaggaggaggagtggagggcgctgcaggcacaccgcacccagctgcaggaggcggctctgcaggacacacggagccagctggaggaggcgcaggggaaactgcggtgcctgcaggaggactttgtctacaaccttcaggtgctggaggagcgggacctcgagctggagcgctatgacgccgccttcgcccaggccagggagtgggaagaggccaggcgggcagaggtgagcgagctcaagatagaggcagctaagctgaggcaggcgctagccagagaggccaggaaggtggaggagctgcagcagcagcagcagctggcattccaggagcatcgcctggagctggagcgcgtccacagtgacaagaatggtgagattgaccaccaccgggaacagtatgaaaatctaaaatggacactggagagaaaacttgaggagctcgacggtgagcttgctctgcagagacaggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggacctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcagctccgcagggcagagtggagacaggctgacaccgccaaggagaaggacgctgccattgaccaacttcgtgaagatgcatcaactgtaaaatctgcctgggatgctcaaattgctcaactatctaaggagatggtctccagagaccttcagattcagacgctgcaggaagaagaggtgaagctcaaggcacaggtggcccgatcccagcaggacattgaaaggtacaagcaacagctgtccctggcagtggaaagggagcggagcctggagcgtgatcaggtgcagctgggcctggactggcagcgccgctgtgatgacattgaaagggaccagatccaaaagtcagaggccctgattcagggtctgagcatggcaaaaagtcaggttgctgccaagctgcaggagacagagcaggcgctacaggagcaggaggtggtgctgaaggccgtgaccctggaacgagaccaggccgtgcaggccctgaggatgcatgggctccccagaccaggggcacagatgcttctcaggcagcatgaagaagaaataagtaaagactttccatccagtgagatccagcggctccgagagcagaacacgagcttgcgaaacgcgattgcccagatgaggaaagaaatggaggctctaagccatcagattcctcctcccatccagacagcggcagagagcacagatgcaaaccagcctgacccagaggctgggggagatgccgccactcctgattatgttctggcccttgaagcagaaatacgaactctaaagcataagtttaaaactctggaaaagcatctagaagatgtgttggatcctttaaagatgtcctcacctcatgctgagtctcagcccagcgtccgcacctcgacagagacgactggagggtctgcccaagctggtcaagccggagggtctgtccaagctggtcaagcaggaggatctgtccaagctggcccagtatcctctggactggcactcaggaagctcggggacagagtgcagctcctaaacctgctggtgacacgactcagacagaaggtgctgcgggaacccctggagccggccgctctccagcgtgagcttccccgtgaggtggaccaggtacacctggaggttttggagctgcggaagcaggtggctgagctggggaagcatctcaggatagcccagcacgggggagcggagccttcaggcaggaagcagcccccagcctcggacgccgtggcccttgggagagagcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacattatggactgacttcctccccccaccccgccccactaaggggtgctcggggcctccgcatggtgcctgtgctttcacctacgtgttgtgggggggtgtgggcacagcgtgcagggtggaggcagggagctgcagggcaggctcccaaatgctgctgaggcgaccctgctgactgaaggcctccctgagcacagggcccattaaaaccaggttcctccctgggg

SEQ ID NO: 2549 - DNA, 3000 bp, Homo sapiens; identical to SEQ ID NO: 2548

SEQ ID NO: 2550 - DNA, 2450 bp, Homo sapiens
agttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccgctttttgatccagtctgtgaagataggccgtggatattttgctattctgagggaagagactgcaaagaaaaagaagcaacaacaacttcagaaactgaaagaggaggaaagaaataaattccagccagccgaaaagatctcagaaatccactatggggacaccttattgagcacatatgatgatgagaagttgaagacactgggagctagagtcacacgtcgcccattcactcccatccacagctgcatcatttctccctcgctaaccgaggctcacgtcgagcccctcttccgccagctctgtgctctccactggcttctggaggccctgactattgaccacacccaccacaccatgaagcctgtgatcacctgctggaacccaaaggacccgggtggaagcaagagcaccattaaaaaaatcaataaggacaagtccatgggacagaaatgggagcatttcatcacagcgccaaagaccaagaaattcaaaattcccacaatgcgagtcaccaaccgcaaaccaagccggcgaggctccacactcagtctgagtcgggccagtggggggtcctctccccagagcagcatgatctctgtgaaccctggctcggatgagcccccaagtgtgaacacccaggtgaccagcagcaaggacattgaggacaatgagtcatcttcaaccaagccagatgaagaacctctgtatatgaatctgcagaagctcctggagatggttcgggaagatgcccggaggacagtcacaatagaaaatgggatgcaaagaaaagcacccagcatcttgtcagtgctgaaacaaaacaagagtaattctgcttataaggaaatgcagaccactctcaaatcaagtgagagatccagcagtacaagtgcagaaagccacatccaaccagtccagaagaagtctaaaaaccgcactaattgtgacatcaacatccactacaagagtggggtgtgtaacaccatgagggccaagttttacagcgtagcccaggaggctggcttctgcctgcaggacaagatggaaatcctcatgaagcgccaagaagagagaggtatccagaagttccgtgcttttgtccttgtctcaaattttcaaaaggacatagcaaaaatgagacatcacatatctgtagtaaaaggagatgcagaagaaattgcagaccactggtactttgatctgttgtccaaactgccagaggatctaaagaacttccgccccgccaaaaagatcctggtgaaactgcagaagtttggagaaaacctggacttgcggattcgaccccatgtcctcctgaaggtgctgcaggatctgaggatttgggaactgtgctcccctgacatcgctgtggctattgagtttgtgcgagaacacatcatccatatgcctcaagaggattacatcagctggctgcagagccggatcaacatacccattgggccctacagcgccctgaggtaggctgggcctgggttgaccagctgtctcagtggaggagtgtttgcctatatcatgttcctgtatcctgcctgtgttcctgcctcctgactaccctcatggatgctctttatggatgaccctttacagtagggtcatctggagactgacttccagcaacatttttagagggggatggccccggtggccctcccctcaattccacaccccagacccaacctaccagtctctgttcttcaatgatccagcctgactctacctacttcctcttcagattccttcaccctatttaccttcctcaagtactggagaataaaattgaactgaatgtttga

SEQ ID NO: 2551 - DNA, 1993 bp, Homo sapiens
agaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactgggcattgcagagagacagagagagagaggaaggctcactggctttgagctctctgggtacagtgtctgagtggaggcaaagtgcggttccttcaagatgtctgtgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgta

SEQ ID NO: 2552 - DNA, 1811 bp, Homo sapiens
tagagtgtcccgcagccacctgtccccgcagatgctgcaggtgacatgagctctccagatgggcccagcttcccgtccgggccgctctcagggggcgcctctcccagcggcgacgagggcttcttcccctttgtgctggagcggcgggactcattcctgggagggggcccagggcctgaggagcccgaggacctagccttgcagctgcagcagaaggagaaagacctgctgttggccgcggagctcggcaagatgcttctggagcgaaatgaagagctgcggcggcagctggagacgctgagcgcccagcacttggagcgtgaggaacggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggcctcccagactgagcaggaacttcagagggaactggacgcccttcggggacagtgccaggctcaggcactggctggagcagagctgaggacgcggctggagagtctgcagggggaaaaccagatgctgcagagccgccggcaggacctggaggcccagatccgaggcctgcgtgaggaggtggagaagggtgagggcagactgcagaccacccacgaggagttgctgctgctgaggcgggagcggcgggagcacagcctggagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatata

SEQ ID NO: 2553 - DNA, 3027 bp, Homo sapiens
aaccgacgtacacaaggggcttgagcgttctgtggagagagtgcgagagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaa

SEQ ID NO: 2554 - DNA, 3096 bp, Homo sapiens
ctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatactt

SEQ ID NO: 2555 - DNA, 3047 bp, Homo sapiens
atggatttattagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagt

SEQ ID NO: 2556 - DNA, 2248 bp, Homo sapiens
atggatttattagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatatt

SEQ ID NO: 2557 - DNA, 2664 bp, Homo sapiens
atacgcggtcctgcgccctcgcctcagacctctcgggcgagcgcggcgcagcgcagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattc

SEQ ID NO: 2558 - DNA, 1031 bp, Homo sapiens
attaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaa

SEQ ID NO: 2559 - DNA, 2730 bp, Homo sapiens
ttgagtttcgttccagcttctcctcttagaagctattctcttctccctgaagggaggcaacactgtccgttcgcctgactggcagtgttttaaggacccatcgcgcttgacgggaaagtcagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattc

SEQ ID NO: 2560 - DNA, 4132 bp, Homo sapiens
ggggcctcaccggcgccggactctgccctgggcgcgccccgcggggcggagccaagcctgcgggcggtggcggctgcactcgcagggccctggcagccgaccctggccccaaggtccgatcgcccaggggaggagcagcaccgggaccccgcgtcggctgggcgccccacaagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttacgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctgacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatgaa

SEQ ID NO: 2561 - DNA, 4023 bp, Homo sapiens
gttgctattttgtgaattactgataggcatgttatttgttagcttatttgtttacagtatgctcaacattgaaggtgagttgtaatccaaattttggccaaagctaaaaaattcaaaacagtctgttttgcttagctgatttatgttttcctaaagccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttacgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctgacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatg

SEQ ID NO: 2562 - DNA, 4132 bp, Homo sapiens; identical to SEQ ID NO: 2560

SEQ ID NO: 2563 - DNA, 3451 bp, Homo sapiens
atttacggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcacctta

SEQ ID NO: 2564 - DNA, 2993 bp, Homo sapiens
ttaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccagggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctc

SEQ ID NO: 2565 - DNA, 1899 bp, Homo sapiens
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaa

SEQ ID NO: 2566 - DNA, 1173 bp, Homo sapiens
ggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatgtatgtattctgtatatactgtcaattttcttaaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacgtaagtttccactcattaaagcatta

SEQ ID NO: 2567 - DNA, 2133 bp, Homo sapiens
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaa

SEQ ID NO: 2568 - DNA, 482 bp, Homo sapiens
aaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatgctaatagagtttctgaaatactttggaaaagtctcccaaaccttcagagagtg

SEQ ID NO: 2569 - DNA, 700 bp, Homo sapiens
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaggataaagaaaatcgaccagaagcagtgaaaagttgtgaagctctggcacagaaaattgaagaattcttagaagcccactcaactgatgaatttaaagatgtttctgcaacagaaccacagctgtaaatgatcaagttttgttagatgctgaatacaaacagatgcag

SEQ ID NO: 2570 - DNA, 657 bp, Homo sapiens
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaaaactgctcattcaatgactaatcgatttaatgccatgttgaaagtatttgaaaaccaggcaaatatgttggagagagctgtaaatgatcaagttttgttagatgctgaatacaaacagatgcag

SEQ ID NO: 2571 - DNA, 581 bp, Homo sapiens
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaagctgtaaatgatcaagttttgttagatgctgaatacaaacagatgcag

SEQ ID NO: 2572 - DNA, 3998 bp, Homo sapiens
agtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaggataaagaaaatcgaccagaagcagtgaaaagttgtgaagctctggcacagaaaattgaagaattcttagaagcccactcaactgatgaatttaaagatgtttctgcaacagaaccacgattaactccttgggttgccaaataaacccaaaacattgaatttaatgtgtatgcagaaaccaaatccacttttgcttgttcaagtggatccaacttctgcaacaactcatttctagaaacagacatcgtggtcttcagcatctcatccacagcaccaatggaattctcaaacgctgacaaatactcgtgaatttctactggatagtcttcattaatttcttcacctgccgttatggctgactcacggccttcgactccagcctcccggaaagcggtcgggcaacgatgacgacaatgacgcgccagctctgcccgcgccaccagcggcgctttccgatgatctcaccaatgtatagctttttatacacaaattacataccaataaagtgatttaaaagtataggataaaatatagaaactaggattttattaaattattatgcataaatttatatagtagcaggataggacaatcatgttggtctttgggggagctaatagacatattcttcaggatcttgtcagtgcattgtctagctgttcacctgtgcatattgagaaataaataaataggcatagatctagagggccttgaaattcttttgtaattgtgggacaaattgagatctcaattagatattgatttgttggatggtttgtgaagatatgattcctttttggtgaacagaatgcttagaactagtgttcagtcttagagatgaagttgttaagttagataagaacaatgtacattacctgaatcatgtggtctggacaggaaagcagtcctgttaagaattccttcatgacatttttctagggaggcatagatgttacaagtgaaggtaataggctgttttgcctttcaaagcgtctttagcccaagtgcatgcatcacaaatagtcaccttatgtcagaattggaatcataataattctaacatggcaaattcacattcgtgaatgaatttcagtgattagctagggcataggcaaggcaaaggcatccatgtggttaaaaagtaatgacagattctgaattcacatcatttaaaaaagtaacattgattacagacctaaatgtaagaaaataaaaccataaaaagggagggaattcaactcccaaaactgaaaacacctcgttcaaaattgaagcaaagttacaaggtaagcagtagactgggagaaaagatttgtgctcatacagtagaaaaaaggagtactaataagaatctataactccctaaaaacacataagaaaaataggcaaagtatataaagaggaggtaactaagggaaagacaaaaaaattggccaataaacattttaagagatgctcaatctcaccgtgatcagggaagatataagacaaagccatgacttttttgtctacaaaatttagaagttttctaatatcaactattggcagagaggtagtggaatgaatactcttaccatgctaatataatagaaatttccccctttcgaggacaatttagcacagtttagtaataacaaaagtgtatgccatgttatatagcaaatctctttttatctaccctcgggaaaggagtacaatgtgctcaagaaagcatataaaaggaattttttttgcatcagtgcgatggtagcagaactagaaagaacctgtttttgttagtaggagtatggctcaataatctatggtaaatggataataagggaatactatgaataactatgtgaccacaaattagataacttagatgatatatatctctagaaaaacccaaactaaactgtatcaagaagaacaagaacatgtgactgaacttataagtagtaaaagatttaattagtaattaacatattcccaccaagaaatgcttaggccagatgacttcactttttaatcctgtcaaatatttaaagaagagttaataccaggcctgtacaaactcttctaaaaaattaaagagttcacacttctcaattcattctatgagattagtgttactctgataccaaaattagacaatcacaagaacataaatatgatatttattttaagaagataaatatatgttatgaatatgaacatgaaaatccttaccaaaatactagcaaactgaatccaacagcatataaaaaagattatctatgatgaacatgtgagatttattttaggaatgcaaggttgatttaaaatgcaggtatcaatttacataatgtgtaatattgattaaataaaggagaaaaaattacatcagttcgctagattcagtaaatgcacttgacaaaattcaacatctttttatgatacaaagttccacaaaccaggaatagaaggaaacttccttaacctgatgaaggccatctacaaaccccatggtcaacatcatactcagtggtgagaatgaataatttctccctatgatcaggaacaagacaagacattcacttctattcatcattatagtggaggttctagcaagggcaattatggaagaaaaggaaataaaagtgtctgcattggtgaggaagaagtaaaactacctctatttgcaaatgacatgattttagatataaaaacatcctgagttctgctaaaacctattggaagtaatgaatgaattcatcaaggctgcaatatacatgatcaataaacaaaaacaatttgtatttctatacactagctgttatgggttgaattgtatcccctcaaaagatatgttgaagttctcaccccctgctacctcagggtgaccttatttggaaacagggttattcccgatattattagttgagatgaggtcatactggagtaggatgggcccttaatccaacgtgactaatgtccttataggaattggaaaagacagataaacatggaggaaatactgctaatgtaaagatagagacagagactggatttattctgccacaatccaaagaatgccagggactaacagtggctagaataggcatggtggtttccttccccagatatttcagagggagcatggctgtgccaacactttaattttggatttcaagtcatcaggctgtgagaaaataaattcttgttgtttt

SEQ ID NO: 2573 - DNA, 1781 bp, Homo sapiens
gttggagcagcggaggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttcca

SEQ ID NO: 2574 - DNA, 4232 bp, Homo sapiens
gagacgccagcagcagccgccgccgcggagccaacgcggactgggacggcggcggcagtagtgggacccggcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaaccatatggtgtgtgattaaaaaaaatgaataaattgtgaagaactggttttggttacaggagtcactggaatccgactggagatgatttggccccctgtcctggtctaacatacaaatctaggaatattatgcgttaaagtattttaaaatacattatccttgtaatgtattttacaaggataatgtattttaaaatgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcacctcgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttttaatggacatacatgcctaatatttattggtgtgtttaaaatattttttgatagagtgttatgtcttaagcgcattagaaaacaattgtttgtaatggaatcaaagtgtttccctggacagtttgatgtgcttatggttgagatttataatctgcttgtactttgctttttaacttattaactgtaaataaattttagagaatacata

SEQ ID NO: 2575 - DNA, 561 bp, Homo sapiens
gtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaagga

SEQ ID NO: 2576 - DNA, 1543 bp, Homo sapiens
cagcgacaggccccgcccccgccaaccgcctcgcgccttccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 2577 - DNA, 2809 bp, Homo sapiens
ataatgaatcagacatcacagaagaaaggtgagaactgggcccttcagtgactgatgggatgctcttgccacccaggggagcccctccagactgtccttgcccacctggctgcactggcccctgtatgccaacccagtgggtacaggttctgggggacctggacagatgccgctacctctagccgtggctggacgatgttatgcagccaagcacagcacgtgctgctctcgggaagcccagggcctgaggtcattgcagtggggaggtgggcacagggtgctccccagacctccctcctccaagtagagctgaaatgggaaggaacccctgggacagcccctgccctgctagatctttgcctcagattgctgctgtggccaggcccaggatttccagccctatggctctgagtcctcacatgctgggggcccaggggctctggacacactccatccagggatcccttcctgccatctgggcagcaaccatggggacaaagggaggaagcagagtcctgtttccttgccacttgtccaaggcacttccccatcctgacagcggcccccacccagcccaggatcctgggctgtggtctcaagctcacttcccattatctttggggctggggctgacatcaggaggacatctgactggtggatggagccagcctgggaacatcgcagctggggcagtgcctagggctctcccttcccagggagacatggagaagggggttgagggagggcccttccctagccgctgtggcaactccagtgagctgttctgggcaaagtgtggcccaagtcggcagccccagccctgcagtgctggggacgctgacaggacacgggaagaggccatgctttccctcgggacctgctgttccatgtgtcccaagccctcctgctttccagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctcctgggctcatgatagcagatgacggccacgctctacccatcggtgggcgctgtcttcctcccttcccctgggggtcctgcagagtacctgtgctgacctgagcccacgaggggggccagtagcagcccctaaaccacttcctcagagaaaagtaaagtaatattcttaccaagagaaggcttgctgcccctggccacagcctgcctttggagggcactaggccagcaggtcagagtaggaacaggttctggtgatccctgagtttgcgggactgccctgagatgctacagagtgcacactttcagcagcgcaaccagcaggacaggctcctgcatctgcacatcccaagaccaggcctggagcaagatgccccactgggtgtggggtcacgatcaagagcagcctggcagctagctggtcacccactgaagcccatctgacccttagggcaccttcagaggggagaaagggacaggccccagtcccagagacccccacctggtgcccagagcaccctgctcagtgggagaggggaaccaggccctcttccccacattggcctgggcgctgcctggggaggtatgctgggtgggtggttagacgcacctgggcaggtcacctctggctgctgcaatgactgtttcagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttcc

SEQ ID NO: 2578 - DNA, 1298 bp, Homo sapiens
cggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 2579 - DNA, 1549 bp, Homo sapiens
cagcgacaggccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 2580 - DNA, 2459 bp, Homo sapiens
gtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccgttacaagctcataatgaatcagacatcacagaagaaaggtgagaactgggcccttcagttcctgatgggatgctcttgccacccaggggagcccctccagactgtccttgcccacctggctgcactggcccctgtatgccaacccagtggggacaggttctgggggacctggacagatgccgctacctctagccgtggctggatgatgttacgcagccaagcacagcacgtgctgctctcaggaagcccagggcctgaggtcattgcagtggggaggtgggcacagggtgctccccagacctccctcctccaagtagagctgaaatgggaaggaacccctgggacagcccctgccctgctagatctttgcctcagattgctgctgtggccaggcccaggatctccagccctatggctctgagtcctgacatgctgggggcccaggggctctggacacactccatccagggatcccttcctgccatctgggcagcaaccatggggacaaagggaggaagcagagtcctgtttccttgccacttgtccaaggcacttccccatcctgacagcggcccccacccagcccaggattctgggttgtggtctcgagctcacttcccgttatctttggggctggggctgacatcaggaggacatctgactggtggatggagccagcctgggaacatcgtagctggggcagtgcctagggctctcccttcccagagagacatggagaatggggttgagggagggcccttccctagccgctgtggcaactccagtgagctgttctgggcaaagtgtggcccaagtcggcagccccagccctgcagtgctggggacgctgacaggacacgggaagaggccatgctctccctcgggacctgctgttccatgtgtcccaagccctcctgctttccagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttcc

SEQ ID NO: 2581 - DNA, 1296 bp, Homo sapiens
atggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 2582 - DNA, 613 bp, Homo sapiens
gagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcct

SEQ ID NO: 2583 - DNA, 3570 bp, Homo sapiens
atgcgcagcgcgcgctctacggcgctgaaccggggcgagcagagagctgtcagatactatagccatatgaagttgaacatggcagaagaagaggactatatgtctgattccttcattaatgtccaggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttccctccatccaagcatgaagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaagttcatatgctcaggtgtctctcctagtgattgattttgatttgtcttggctaaggtggttcctggatatctatatatttattttgaagtcccaagaatgagtgataagcacctgaggataagaactagtactgaggttaaggatggagcaccaccattctttggatagagttgtgatcacctgtgtgattttatagctcacctgttagttagattgagcaagagaacaaccccttttattagaaacagcatacataagaagattgtaaaaattaacctacacttgctagggtaagataatcagtagtacaatttgtattaatctctgacctaatatgacctaattcacttttcaagtttaacttggggagctttacaaaatagtaataaaagggtcccatcccaagagattctgatgccattagtcactgtgacttgggcatcactgcccttgattctaaaatgcagcctaccttgagccactaatctagttaacttctgggcctcagttcttcatccagaaaactaatcattatttttatgaatgtaaatatgtgtatatatataatatttatatgtttggatgctattgtttaatatttacttttttgtttttaaaaaaattataaaattggctgagcgcagtggttcactcctgtaatcccagcactttaggacgccaaggcaggcagatcacttgaagccaggagttcaagaccaacctggccaacatggtgaaaccccatctctactaaaaatacaaaaattagctgggcgtggtggcattcgcctgtaatcccagctactcagaaggcggaggcatgagaattgcttgaacctgggaggcagatattgcagtgagctgagatcatgctgctgcactccagcctgggtgacagagcaagaccctgtctcaaaaaaaaaaattatatatatatatgtatgtatatatatatatatatagagagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaaaaaaaaatcagactttcaatatgagtaacaagttatttttaggccttttatgactttataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaaattggtttttctaataaacatttatttcaagtgtta

SEQ ID NO: 2584 - DNA, 3906 bp, Homo sapiens
aatagagtctgcactaggaaactggtgggagccgaggtccggaagtccgacgctggtcggtgggcgcatgcgcagcgcgcgctctacggcgctgaaccggggcgagcagagagctgtcagatactatagccatatgaagttgaacatggcagaagaagaggactatatgtctgattccttcattaatgtccaagaagatatcagaccaggattgccaatgctaaggcaaatccgagaagcccgtcgaaaagaagaaaagcaacaggaagccaatttgaaaaacaggcagaagagtttaaaagaagaagaacaagaaagacgtgacattgggttgaagaatgcactaggctgtgaaaacaaagggtttgccttgctccaaaagatgggctataaaagtggtcaggcacttggcaagagtgggggtggtattgttgaaccaattcctctcaatatcaaaacagggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttccctccatccaagcatgaagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaagttcatatgctcaggtgtctctcctagtgattgattttgatttgtcttggctaaggtggttcctggatatctatatatttattttgaagtcccaagaatgagtgataagcacctgaggataagaactagtactgaggttaaggatggagcaccaccattctttggatagagttgtgatcacctgtgtgattttatagctcacctgttagttagattgagcaagagaacaaccccttttattagaaacagcatacataagaagattgtaaaaattaacctacacttgctagggtaagataatcagtagtacaatttgtattaatctctgacctaatatgacctaattcacttttcaagtttaacttggggagctttacaaaatagtaataaaagggtcccatcccaagagattctgatgccattagtcactgtgacttgggcatcactgcccttgattctaaaatgcagcctaccttgagccactaatctagttaacttctgggcctcagttcttcatccagaaaactaatcattatttttatgaatgtaaatatgtgtatatatataatatttatatgtttggatgctattgtttaatatttacttttttgtttttaaaaaaattataaaattggctgagcgcagtggttcactcctgtaatcccagcactttaggacgccaaggcaggcagatcacttgaagccaggagttcaagaccaacctggccaacatggtgaaaccccatctctactaaaaatacaaaaattagctgggcgtggtggcattcgcctgtaatcccagctactcagaaggcggaggcatgagaattgcttgaacctgggaggcagatattgcagtgagctgagatcatgctgctgcactccagcctgggtgacagagcaagaccctgtctcaaaaaaaaaaattatatatatatatgtatgtatatatatatatatatagagagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaaaaaaaaatcagactttcaatatgagtaacaagttatttttaggccttttatgactttataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaaattggtttttctaataaacatttatttcaagtgtta

SEQ ID NO: 2585 - DNA, 711 bp, Homo sapiens
agggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtg

SEQ ID NO: 2586 - DNA, 3129 bp, Homo sapiens
agaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggc

SEQ ID NO: 2587 - DNA, 476 bp, Homo sapiens
ggaagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagcttgaattctacacttaaagatcatattatgtcccatccagcattacacgatgcacttaatgaccctaaaaatggcgattctgcaaccaagcacctgaaacagcaggtatgtttaggctatagtaactacta

SEQ ID NO: 2588 - DNA, 1611 bp, Homo sapiens
agaggccttggcaacgcacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctggcaggcagtggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaagagacccggtggagcctcccaggggggaacatcagagccacagggcctggacgctgcatcctgggcccagatccaccagaagctccgggacttctcccgcagcacccagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaaccca

SEQ ID NO: 2589 - DNA, 3051 bp, Homo sapiens
agtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgaggtgcagcccaagaacaccatgaaccccgagaatgagcagcacaggctggggagcggcgtgagtgtgcagccacctagctcaggggagagggcagcaccagagaccccaagcctagggtctcatccagccagccctgtgtgccccacagctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgaggctctgccctgactgcttggagacctggagggtgggggccccagaagctcagccggggtccactctcagggcacaggtggagggctgcttccaccccaggtgctgtgcagctgccaaggccagctccgtcaggcagaggctgaaaatgcccggctgcagctgcagctcaagaaactgaaggatgagtacgtcctacggctgcaacactgcgcctggcaggcagtggtgagccctgcaggagcaccctgaggcctagggagcccaagcctggcctgggtgtgctggatagcttcagggagaccccagggccccggcactgctcagcctgctggggtggggggatggttggaaaagatggggggtgggccccatgcggacccagcccgccgcctccaggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacaggtgggccccgctgggatgggaggtgtcaggcatctgtgggtctctaagcctctgtgcctcaaaggcttggtgtgcagcaggagtggccccagacagacactagcctaccctgacagggcacctgggaacccccaagctatttttgacatagccagcttggacctggaaccattgcccgtgcccctggtcactgacttcagccatcgggaggaccaggtgaggctagagacccccagaagctccaggcccgggtgccccccacccacccactgccccacactggccccaggcctcatcctgggctcaacagagacctcagccccgggcctctgaggggcttgccttgttcagccaactgaaacgtccccaccacaaacctctgtagcacggcgggcctggggcactgctctcatccccaaaaaagagacccggtggagcctcccaggggggaacatcagagccacagtgagtgccctcatgggtgtgggggaggcctgtgggggatgagcagagagcacaacgcctgcaccctggggcccccagttgctccaccaagcccccgccagacagggtctggtcacagcaatgcactcagtggcacatccccaccctggggtccctccgtgggtcccggcgacactgataatcacaggaaagagaagaggggctgctgcaggtggagctggccttgaacacggaggatcagggagagcacacctgagggaggtttccgctgagacctggaggacgcgaggggtgggagcagggcgcctggtgaccgggccagcccttgcctctgggcctccatgttcccagctgtacaatgggcagggctccccaaggaccatttcctggggtttagggcacacccgtgtgggggtggcatccctgttgatgctggagtcactgtctgggctggccttgtggtttagccctcccccagcagccagcagaccccctgggcccgggctgtccctatacacggatggctccaaggcctggggggcgccacaggagcacgggggggcccatgcctccctcactcactcccaggtgtcccctcccggctctgggaacctgactcagcacggtcacgtctgtccctgtgtcaccatgccagctctcaaaaccactcctcctttcctctcccctcacaggggcctggacgctgcatcctgggcccagatccaccagaagctccgggacttctcccgcagcacccaggtaggaggcaagggctggcccaggcccatcctcacgccatgccccagctcatggcttacatccccatgccaggcagagctggaacgggagcgggcacagctgctggtccgggccacgatggctgaagagcaactttctgagctacaggagtacgtggaccagcacctgggcaggtgggcagagggagctgggtgtgaccccagggccctggtctggttggaatgaaggatgatggctgcctcaggcgctaaaagcagacctgtccacagctgggcaagtcacttaagcatggttcctctgagcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaaccc

SEQ ID NO: 2590 - DNA, 2255 bp, Homo sapiens
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgctgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 2591 - DNA, 2305 bp, Homo sapiens
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgaggaaaatcagtatgacctttttaaaaacaatgggcttccactcatgattcaagccttaactgaatcgcagaatgaggaactgaacaaagctgccacatttgtgcttcacaactgcaaaaaaattactgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaaggtatagtttaataattgtgtgttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 2592 - DNA, 2446 bp, Homo sapiens
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgaggaaaatcagtatgacctttttaaaaacaatgggcttccactcatgattcaagccttaactgaatcgcagaatgaggaactgaacaaagctgccacatttgtgcttcacaactgcaaaaaaattactgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagtgaccatgtttttaaacacccagttcacattgccaaaaatataaagcagcagttaccagtaacagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 2593 - DNA, 2381 bp, Homo sapiens
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgaggaaaatcagtatgacctttttaaaaacaatgggcttccactcatgattcaagccttaactgaatcgcagaatgaggaactgaacaaagctgccacatttgtgcttcacaactgcaaaaaaattactgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 2594 - DNA, 2636 bp, Homo sapiens
tagcaaccgagcgagcctttctcgcgtcccagcaacgcgcccttccctctgccgggcctattctccctggtgcccctcccttcctcgaggctgcagctcacccctcattgggtctctcgttggtcaggagggcgcgggtctgcacactctcactcggtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagggggttcagattccagcatttggaactttcactttcataagacaaaagcttgaggtgggaaacaacaaatttatcttaatccagaggcctgtgtttatcatggtggagaagctagtgcagattcatggactcaaacaaaacaaagtatatactcctggtgaaatcccaattgttccacttaattttgtcatgatatccctggagggtccatttaacagagatgtagtggaaggatgtgtgaaggagacgttgctttttttatcgcgttccatttccatgaaacaaaatgtggagtttacattcaaaggaattggggtcctcatgatcagagacagcaaagtgaagatgaggttttataaagacttcctttgtaccatggatggaagtggggctttggcaaaggccctagcaaataggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatattttttaagcgcctg

SEQ ID NO: 2595 - DNA, 2510 bp, Homo sapiens
tagcaaccgagcgagcctttctcgcgtcccagcaacgcgcccttccctctgccgggcctattctccctggtgcccctcccttcctcgaggctgcagctcacccctcattgggtctctcgttggtcaggagggcgcgggtctgcacactctcactcggtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagggggttcagattccagcatttggaactttcactttcataagacaaaagcttgaggtgggaaacaacaaatttatcttaatccagaggcctgtgtttatcatggtggagaagctagtgcagattcatggactcaaacaaaacaaaaggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacaggaaatgtgctatgtatgtttgcaacgagcacaacgaaattccctgttgtactacagtgaggaaaggaggagagagatagaagatgagagactcatacagcagtatcagatgttaaaggatcaggaggctctcttcagacaccagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatattttttaagcgcctg

SEQ ID NO: 2596 - DNA, 2528 bp, Homo sapiens
gtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagggggttcagattccagcatttggaactttcactttcataagacaaaagcttgaggtgggaaacaacaaatttatcttaatccagaggcctgtgtttatcatggtggagaagctagtgcagattcatggactcaaacaaaacaaagtatatactcctggtgaaatcccaattgttccacttaattttgtcatgatatccctggagggtccatttaacagagatgtagtggaaggatgtgtgaaggagacgttgctttttttatcgcgttccatttccatgaaacaaaatgtggagtttacattcaaaggaattggggtcctcatgatcagagacagcaaagtgaagatgaggttttataaagacttcctttgtaccatggatggaagtggggctttggcaaaggccctagcaaataggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacaggaaatgtgctatgtatgtttgcaacgagcacaacgaaattccctgttgtactacagtgaggaaaggaggagagagatagaagatgagagactcatacagcagtatcagatgttaaaggatcaggaggctctcttcagacaccagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgct

SEQ ID NO: 2597 - DNA, 2941 bp, Homo sapiens
ggctcactggggactcctttaaattttgcaattggtgttattaataagatgataagagggaagtctgcaaatactcttttcttgcctggtggataataatttacagaagtttctggcctaactcgtgcagtaaaattcggttacataattttttaaaaaagcatatttgtaaactctaaaccattttaatcgttatttttctgaaactaaaatacagcatgaatgagagataaaaataatgatttttaaaggcttaatttttactatcttgtacaaatgtgatattggcagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 2598 - DNA, 1878 bp, Homo sapiens
cagcacaacatacaacgtaattcagagtagatgttcatataattatttcatgggcattcagtaaattatttgttaaattaatgttctaccatcttcactcagatatttcatgtgattttgtgtttgtggaccattaaataaagccaaataaatataatttataccataaatgcattcattgctctaatctggttatcactgttatattcctaacaactttattttatagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaa

SEQ ID NO: 2599 - DNA, 236 bp, Homo sapiens
atctataggaaaaaagtaatcctcttggaaagctggaaacatagtccgattttttatagtgtgtggtttatagaaagactccaggaatattctgtgctgtggtggaaatattggaataatcagcctcataagaagcttaagtgaaaatgatacatgttagaagacatgaaacaaggagaaattctaagagtcacgtgcctgagcagaaatctcgagttgattggaggcgaactaaa

SEQ ID NO: 2600 - DNA, 849 bp, Homo sapiens
cggactagtgggctagcgggcgctgggttcctgcgtcccgccaaagagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgagg

SEQ ID NO: 2601 - DNA, 2848 bp, Homo sapiens
atcgcttgtcctgagctggttgccggggcaggggcggaggcggaggcagaggtggaggcgctttgaaagaaaacatcgaagaggagtgatgttttacacccaagaatggatccctcctggtagaatttcaaataatgacctggggttccactgcctttcaaatctgtaaagtgttaactaccacctgcattgtttatacagcaaccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtg

SEQ ID NO: 2602 - DNA, 2358 bp, Homo sapiens
aaatgcagggcgcagcagccgctgcagtggagccggtaggcctggccggcgggctgaaaggaagtgcgagctgtccgcccagggccgggtatccgcccctgcaggctgtggaggggatgtcaggagactggctggcctcttttcttggcccccgactccttccagtctgacactgaagactttataagcttccccccgaccaccctccacgggctccactctccacgggcctgggcttgcgccgcttcgagatcagcctgggggtcgcgccctcctggtcttgtccacgaagcgccgttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggtatccagtgctacattcctgtcccacctctaatcctcgtcatctgctgctgctgcctttggaatcatgtctaatctctgccaggcgttgctggcgactatatcttacccaagctgctggactagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactgggtaatttataaa

SEQ ID NO: 2603 - DNA, 1969 bp, Homo sapiens
gttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggcgactatatcttacccaagctgctggactagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactgggtaatttataaa

SEQ ID NO: 2604 - DNA, 2081 bp, Homo sapiens
aaatgcagggcgcagcagccgctgcagtggagccggtaggcctggccggcgggctgaaaggaagtgcgagctgtccgcccagggccgggtatccgcccctgcaggctgtggaggggatgtcaggagactggctggcctcttttcttggcccccgactccttccagtctgacactgaagactttataagcttccccccgaccaccctccacgggctccactctccacgggcctgggcttgcgccgcttcgagatcagcctgggggtcgcgccctcctggtcttgtccacgaagcgccgttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggcgactatatcttacccaagctgctggactagaagtgccacctgaagaaatgtctttggaattgccagaaacacatatagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactg

SEQ ID NO: 2605 - DNA, 1202 bp, Homo sapiens
gccgccggatggcgtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaaaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttccaaatgta

SEQ ID NO: 2606 - DNA, 3982 bp, Homo sapiens
gcgccgcggtgcccggcgcgccctccaagctaggagaggggagaagccgggggctgcagctgggcaagggggaggaaagtgcgtgtgcgtgcacgcctgtgtgcagggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccccagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacgaatcaaccttgtcctatgttaggcagctggaggcaagagtaagacagctggaggaagaaaatcgcatgctgccccaggccagccagaatagaaggcaacctccaactagaaacagctcaaatatggagaaaggctgggggtccagagcccggcgggtcttgcagtggtggcaagggtgccgaggaataggacgatgcctgcctactctcccgggttcttttaggttgtcatcaggggctgatgggagtaacagttcacccaactctgcagctagcttcagtggacatgccacaccttcccagcagcctgaacctgtggtacattctcttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctcac

SEQ ID NO: 2607 - DNA, 5307 bp, Homo sapiens
ggagccccggcgcggggaagcgccggccgggcgagggcgagggcgatgccgcggtgacggccccgccatggctaagcccgcggcgacggcggcggcggcgtcggaggagctgagccaggtgccggacgaggagctgctgcgctggagcaaggaggagctggcgcggcggctgcggcgcgccgagggcgagaaggtgggcctcatgctggagcacggcggcctgatgcgcgacgtgaaccggcggctgcagcagcacctgctggagatccgcggcctcaaggacgtgaaccagcggctgcaggacgacaaccaggagctgcgcgagctctgctgcttcctcgacgacgaccggcagaaggggcgcaagctggcgcgcgagtggcagcgcttcgggcgccacgcggccggcgccgtgtggcacgaggtggcccgctcgcagcagaagctgcgcgagctcgaggcgcgccaggaggccctgctgcgcgagaacctggagctcaaggagctggtgctgctgctggacgaggagcgcgcggcactggcggcgacgggggccgcaagcggtggcggcggcggcgggggcggcgccggctcccgcagctccatcgacagccaggccagcctgagcgggccgctgtcgggtggcgcgcccggcgcgggggcccgcgacgtgggcgacggcagcagtacgtccagcgcgggcagcggcggcagccccgaccaccaccaccacgtcccacccccgctgctgccccccgggccgcacaaggcccccgacggcaaggcaggagccacacgtcggtccctggacgacttgtcggcgccgccgcaccaccgcagcatccccaacggcctgcacgatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacagggattttgatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcatgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatcta

SEQ ID NO: 2608 - DNA, 2915 bp, Homo sapiens
gtcgggctcctggttgccttagtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactacctcatccaactcagccgtccaccagagtttctcaatgagccaggaaggatggatccagtgaaggaattgaagtccatccctcggttgaagaggaaaaagcctttccactggctgccctccataggaaagaagagagaaatcgacatcagttcctcacagatggtgtcgctgcccagctatcctgtggcccccaccagcagggcttccccctcgcctttctgccctgagctccggagaggccaatccatgccctccctgcgtgagggctggaggctggcagatgagttgggccttcctccactcccatctcgccccttaaccccgctggtcttggctacagagagcaaaccagagctgactgggctcatcgtggctgaggatctgaagcagttgataaagaagatgaagttggaggggactcgctacccaccactggactcaggcctgcctcctctcctgggggttgtgacccgtcacccagctgcagggcatcgcctggaggagctggagaagatgttgaggaacctccaggaggaagaagcctctgggcagtgggacccccagccccccaaatcctttccacttcacccacagccagtgaccattactttgaagcttagaaatgaggtcgtggtccaggcggctgccgtacgggtctctgatagaaacttcttagactctttccacattgagggggccggagccctgtataaccatctggctggtgaactggatcccaaagccattgaaaaaatggatattgataactttgttggcagtactaccagggaggtctacaaggagttgatgagccatgtctcttctgaccacttacattttgatcaagggcccctagttgagcctgcagcagataaagactggtcgaccttcctgtcctcagcctttctacgtcaagaaaaacagcctcaaatcatcaaccctgagctggttggactttactcccagagagcaaacactttacagtccaatactaagaagatgccctccctcccatcactccaagctaccaaaagctgggagaagtggtcaaacaaggcctccttgatgaactcatggaaaaccaccttgtctgtggatgactacttcaagtacctcaccaaccatgaaacagatttccttcatgtcatctttcaaatgcatgaagaagaggttcctgtggagattgtggcccctgccagagagtccctagagattcagcaccctcccccattgctagaagatgaagaaccagactttgtgccaggagagtgggattggaacactgtgctagagcacaggctaggagctgggaagacaccccacctgggagaaccccacaaaattctgagcctgcagaagcatctggaacaactgtggtctgtgcttgaggtccctgacaaggaccaggtggacatgaccattaaatatagctccaaagcccgcctgaggcagctgccttcattggtgaatgcctgggagcgggccctgaagcccattcagctgcgggaggcattgctggcgagactagagtggtttgagggacaagcttccaatcccaaccgcttcttcaaaaagaccaacttgagctccagtcacttcctggaggagaatcaggtccgaagccatctccacaggaagctcaacttaatggagtcttctttggtttccctcctggaggagatagagttaatctttggcgagccagtgatcttcaaggggcggccctacctggacaagatgaagagtgacaaagtggagatgctctattggctgcaacagcagcggcgggttcgccacctggtctcggccctgaaggatccccaccagtcaaccctgttcaggagctcagcagccagcctttagtagctcctgggaatacccctattactccttgaccaggcccagtgccctcaaatgcctccctcacccctaaatggccagcagctcatctagacctctttactgctttggaagaagaaatatttgtctatatctgggagtggagggttcaggaacattatgcttccaactatgaagggattgagactaaaactattgttttcttagtgaaattctcatgaaagaatccccaagcctagtagtcccattatgtcaagccttgcacaatacaagccaaatctcctatatcaaaagaactga

SEQ ID NO: 2609 - DNA, 2076 bp, Homo sapiens
cacaggaccggaagtgaccctctttatttcccttcctcacgtggtgcaggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgtgcgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctcc

SEQ ID NO: 2610 - DNA, 1997 bp, Homo sapiens
atttcccttcctcacgtggtgcaggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgtgcgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctcc

SEQ ID NO: 2611 - DNA, 2000 bp, Homo sapiens
ggcccgccgccgcgccggcgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgc

SEQ ID NO: 2612 - DNA, 860 bp, Homo sapiens
gtgggatcgcagggcgagggatccgcattgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccgtaagtacactaccttgccagccccttcctgaagctttgatgcggctttagtttactctgagtaacgatttgcctgtgattcgtgaaacggagcagaatgcacaaacgcagcagagctccaggcttggctactgggctgccgtctgctacggcgacacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatgtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaag

SEQ ID NO: 2613 - DNA, 751 bp, Homo sapiens
caggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccccaacagaatcctggatttgagtctgtcctttgaaagcatctctgctagagttcccacttccaaacccctttcagctcttcgggattcagcctccaggttgccctcggagtggagtctgtggctttccaccggagcagcgcccaggaagtgttttcgtgtgatgaaagttatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacacc

SEQ ID NO: 2614 - DNA, 559 bp, Homo sapiens
agacacaggcccgccgccgcgccggcgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatgtatttttcagtgctgtacaagcgtcttgaattactctggtagcttttccagaaagacccatgacttcaccacatttctcgagttacgatgaaggt

SEQ ID NO: 2615 - DNA, 6899 bp, Homo sapiens
ggcggcggcggcggcggcggcggcggcagagggagtttccgctttgtactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgggtcatggtctgagccaggagagagatagacactgttccctgcactcaaggcaagtagggtgtcaggaggaagagcagtagggtttgcagagatccagggaaacttcctggaggaggcagcatttgagccctatctaaagggagaatcggatgttgataggaagactgttttaaatgaaaatacactatgattaaaaacccaagagagtgcagaggagtacaaggcatgcatgttgggaaaggagggaataagctagtctctgcaggaggcttcagagacccgtctgggaagtagggctgagactaggctttggagggccttgaagggcagctgagggttgattttaatccttggaaatgaccagtgcagatcaaacatggagctcctgctgccctggtcctcaggagtctggtaactcagtcatgttctgtaggtttgtgctccattttgcataaatcttgcaaacataccaggtggcaggtttgcacagtaacacaaaagcttaaacatgtcaagcaagtggggcattcagcagccacagaaatgtgttcatttttagtccctaatggatgtgattaagcagggctgatgtgtacagatttaaaaacacacacacgtgctggattaaaaacagccactggtttcagtgccagggccagcaaggcctacctgagccaggcggaagcagcagcttgcaaatagaaactgccacctgcgagcgcttcttgggtcatgtgcagctccacctcagctggtccctgagccgtggtcatgtgggggttttgaagggctaagttgaagcaagtaattgcaaaagaacaggtggcactctgagggcaggggaaggagacagaagtttgactgcgtttgaaattatttcagtcagggaaacatctgcgttgtcttgttaagcagcttgtaggcccacccctggctaactgaactttgtgagcagttggggcagttatttgaatatttgtccaaaggtggtagggaggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttacatgactttttggtgaagccgtatagggtaaggagatgccccaaggcccctgatcatttcagaagccacctggagcaccagaaggggtcatcttcccagggctatggctctgtgtgcttagacagacatagtatggaattgtgctctaagcccacaggcttctccggagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccagggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagatttttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaatttttaatttggtatacttttcttaatagaaccaaaatggaagaaaattctgattctctaaatctgctttcttaaagataaagcctttgattcaaaagta

SEQ ID NO: 2616 - DNA, 1419 bp, Homo sapiens
gataattacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgcc

SEQ ID NO: 2617 - DNA, 2150 bp, Homo sapiens
gttgccccgggaaacctaacagcgtcctgccggggtccgctgcgctggccgagccgggaggagatggacgtcagctctgagcacactaaggaccccggcggggaaggcggagacggggaaagcctggccgcgcggccgtccaagatcaaggccagctctggccctccgacctctcccgaacccggggagctggagtcggagccggaggaggaggaggaggagcaagcggcttcgcagggaggcaccgccgcggacgagcaggccgaggccccgaaagggctaacggcagccgaggctgcgggcgaggaggggcctggagagccggggaggccggccgagccccagcccgagcccgaagagccggccgaggttggggctgaggagcccgcccagccggagcccggagccgggcccgaggaactagaggcggaggcgggggcggaggaactggagcaggcggcagaggggaaggaagtcaggttccaggcctctctgccgctgaccaggatcgatgaggaagaggctgctgcagccccggaggccgagacagagcgggtggagggggaggaagaggacaaggaggagacgcagagagacggcgcggagagcaaggagagggatggggaaggacgcccggccaaaagccaggaagaggggaagcgcctctatggaagggacgagtttgaggacctcgagtggtccgaggaggtccagaagctgcaggagcagcagctgcgcagcgacctcctggaccagtaccgttccctgctggtggagcggaaccgctcccagcgctacaacctatacctgcagcacaagatcttcgaggcgctgcgcagaaagaagggcctggaggccgctgaggtggctgaccggggcgcagaggccgaggcccccgagaaagagcaagcgtacctgcgccatctgggcatgctggaggagctgaagaagcagcaggcagacgacctgcagtggtaccaccaggagctgggccagttgaagcggcagtgccaggagaagctcaccagggtggagaaggagtggcgacgcttccaggcactcaagaagcaggtggtgatgcaggccatgggcagctgtcggatgaggggcgggcgccaggctgctctgcgagaggtggagcagatccaggcgttggaggataaaaaggagaaggagatgagcgccgtgcggctggagaacattcagctgaagcagagcctggtgcattttgaaaccaggatgaggacccaggaggacctgacccagggtctgcttcttattgactttgaacagctgaagattgagaaccaaaccttcaatgagaaaattgaggaacgaaatgaggaacttttaaaacttcgcagcaaggtgaccaacagtgtgcaagtaataacccacgtgaaggaaaagctgcacttcatggacatggagaacgcgtgcaaaaagacacagctggcagaaatcgaggcccaggccgccctaggaagagacatcctgaccaagacgaagcaagcccgagaggggctgcggacggacaacatcagactgaatcagaagtgcggccttctaggcaaggactcacttcttcgggacttggaagaaaaggtggacaagaccgaactgcttcaccggcgcctggaatccctgaagcgccaccacgctagcctcactttgtcctgcagaggcgtgaggcagaagatcagggaggccaaagcctttctcccttcttgaccagatcgatgagaagagtctgcaaaacacttcatcctcaggacgtgctgtcctgctttattttaccttcgttgctattaaaaaggcctgtgtcatttgggacgggactctattttgtatttatctcaaaacgttttagcttccaaatcagtgctgagcccaaacctgggttaggagttttatctgggattgagcaaaaataggtccagaaaagcaaacaaagggtgatttaatgtaactgacttctcatgaaaaactgtcaaaagtctcaagtctgagcaattctataatttcagtgatgtaatactaaagagtactgttcctctttcatatgtaggagggtttaaaagttcagcgaatgggcaaggtacaaaaaaaccctgtgcattaagctaattattaaattctttggatttatt

SEQ ID NO: 2618 - DNA, 3319 bp, Homo sapiens
gcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgct

SEQ ID NO: 2619 - DNA, 832 bp, Homo sapiens
gtctcttggcttcctctctttgtccaacgtagaagagacaatggaacccctctaccaggctgggtccattctcatgacggtgaataccctacaggggaaaaaaatgatagagagtggcctccagtctggagacttttccctgtcccagtcatggccctcctgcctcccaccacccgctgacttggagatcctgcagcagaaggtggccggggtgcaacgggaactggaggactttaagaaagaggcattgaagtccattcattaccttgaagacgccttctgcgagatgaatggagccctggtgcaacaggaggagcaggcggctcgcgtgaggcagcggctaagggaggaggaggaccgtggcatcgtgcgcaacaaggttctcaccttcctgttgccgcgcgagaaacagctccgggagcactgcaagcggctggaggacctgctgctggacaggggacgtgacgccctgcgtgccaccaagaagagccaggctgactgaacctcgtgggtggcactagccaagcaccaagttgaagattttttttaacggaaggagaaaccccaagtccctacccccttgctttcccttcctcatttccattgctttccttctgcctaaataacaccttgctgagaggcaaaaagacttcaatattttttttggtgaaattccatttatccagcattctaaaggaaggaggcaccccagtactgagtcaggcccctgtaactttcacttgaactgttttcctgtttgtaatggtactattgctcaatgtatacctctttatttgtatagtatattcttaaactgattgtgttgaacatt

SEQ ID NO: 2620 - DNA, 691 bp, Homo sapiens
gtggctactcagggcgccgccatgacgagccgggccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccacgcccctcccctgcagagtggccagatggagtcctgagccctggacatgggcccggctttcctggatatcaggacttccaataaataaagactctgtatactggg

SEQ ID NO: 2621 - DNA, 1006 bp, Homo sapiens
cgcggccgcgcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcagtcgttga

SEQ ID NO: 2622 - DNA, 690 bp, Homo sapiens
ccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaaggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgccttt

SEQ ID NO: 2623 - DNA, 3706 bp, Homo sapiens
cggaagtggcgaaggcggggtcggcgctgccgggtgaaatcgtaggacagtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagt

SEQ ID NO: 2624 - DNA, 784 bp, Homo sapiens
gcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccac

SEQ ID NO: 2625 - DNA, 803 bp, Homo sapiens
gcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccac

SEQ ID NO: 2626 - DNA, 1340 bp, Homo sapiens
gagatcggagcttcccgcaggattcgcgcagagcgaggagcggggaggacgccgtttgcgggaggcgggggccgggatcccgacaccgtccgcagtctccccggggtctctcagggaaccgagctggtggccgtccgaggtaagcgccgaaccaaggagaaagcgccgagcgcgtccacaaaacgcccgaggccgcccttctcgccaaggctcggcagctcccgcggcctgcgctggacaagcgagagctggacggaaacggtgggaggccgtaggcggcggctgggggcgcgggacccgcgcgcgggcgcggaggcgggcggggaggccccgcagcccgcgccgccgccagccgccccgagccgcgtgcgcgcgcggccgcatcagctgagcgcgcggcgcgtgtcacgtggtgtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 2627 - DNA, 757 bp, Homo sapiens
ggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaata

SEQ ID NO: 2628 - DNA, 757 bp, Homo sapiens
ggcttccagatgctggcggatccccgctccttcgactccaacgccttcacgcttctcctccgggcggcattccagagtctgctggacgcccaggcggacgaggccgtgttagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 2629 - DNA, 748 bp, Homo sapiens
aatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaag

SEQ ID NO: 2630 - DNA, 1900 bp, Homo sapiens
gtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaggtctgga

SEQ ID NO: 2631 - DNA, 1907 bp, Homo sapiens
ggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaggtctgg

SEQ ID NO: 2632 - DNA, 1397 bp, Homo sapiens
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaatactt

SEQ ID NO: 2633 - DNA, 1745 bp, Homo sapiens
catgtgacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaactaaacaacagttctaaaacttccatgatttttgtagcttcttttgtccccaagttgaagcttttggccagtaccttctctagtttttaaagatgatcccaacttcctaattcccagctaagcccttgacccatggtgtgacatgaaatcaggcaattgaatcgcaccactttctgtgttttcacctgttacgtagaacaaaaggaagcaaggtggccaggcgcaatggctcacgcctgtaatcccagcactttgggaggccgaggcaggcagatcatgaggtcaggagatcgagaccatggtgaaaccccatctctactaaaaatacaaaaaattagctgggcgcggtggcgggcatctgtagtcccagctcctcgggaggctgaggcaggagaatggcgtgaacctgggaggcagagcttgcagtgagccgagatcgtgccactgcactccagtctgggtgacagagaaggactcgtctc

SEQ ID NO: 2634 - DNA, 1335 bp, Homo sapiens
atgtgacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaactaaacaacagttctaaaacttccatgatttttgtagcttcttttgtccccaagttgaagcttttggccagtaccttctctagtttttaaagatgatcccaacttcctaattcccagctaagcccttgacccatggtgtgacatgaaatcaggcaattgaatcgcaccactttctgtgttttcacctgttacgtagaacaaaaggaagcaaggtggccaggcgcaatggctcacgcctgtaatcccagcactttgggaggccgaggcaggcagatcatgaggtcaggagatcgagaccatggtgaaaccccatctctactaaaaatacaaaaaattagctgggcgcggtggcgggcatctgtagtcccagctcctcgggaggctgaggcaggagaatggcgtgaacctgggaggcagagcttgcagtgagccgagatcgtgccactgcactccagtctgggtgacagagaaggactcgtctc

SEQ ID NO: 2635 - DNA, 917 bp, Homo sapiens
gcttccctgggtgccacggtcatgtgacttcggcaagatggctgccctgacagcggagcattttgcagcactccagagcctgctcaagctgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaa

SEQ ID NO: 2636 - DNA, 2972 bp, Homo sapiens
attaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 2637 - DNA, 2635 bp, Homo sapiens
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctt

SEQ ID NO: 2638 - DNA, 1966 bp, Homo sapiens
agcttacggccgacaaaccactcttctctatcagtatgcccttgaatagatgaggttgtgcaaagtcctttgctcttaaatgtattgctgtcattgagaatatttggaggttttctcttgggtttgtttggattttttttttcagcttttgtctgaattttggttttatttttctggggcagagaaaatggctttccttatgaaaagtatgataagtaaccaggtaaagaatttaggatttggtggtgggtctgaagaaaataaagaagaaggaggtgcatctgatcctgcagcagctcaagggatgactagagaggagtatgaggagtatcaaaagcaaatgattgaggagaagatggaaagagatgctgcatttacacagaaaaaggcagaaagggcatgcctcagagttcatctcagagaaaaatacaggctcccaaagagtgaaatggatgagaatcaaatccagatggctggagatgatgtggatttacctgaagatctccggaaaatggtagatgaagatcaagaagaggaagaagataaagattctattcttgggcagatacagaatctccagaacatggacttggataccataaaagaaaaagcccaggccaccttcactgaaatcaagcagacagcggagcagaagtgttccgtgatgtgaggggtgggaggggtggagggagggaaccagccatccttggaaaagaccactctcttgtgggacgtttcaagcagtacatgttttaatgtagtgaacacagttaggaaaaccacgatgatccattgacagacaataatttggttgttctaaatattcctggcagagcatttagctaacaccttgcagcgggaaccttactttccttttagttataaatgagataaactggaaaatttcagttgtaaatgatgatgcagaacacatatctgcttaaagaccttgagatgagccaggaagaaacaaaagcaaggggcatttcctctccaactttcttccttggaggccaagttctcaccctgtccaactattcgcaggacaccaggtcccttcagagagaaatgtggagagtcaaggtgtctactgggagccgggtttcccacagggagctgagtctacagactccagggcaatcaaaggtcaccacccccacccctcacctctaggatccttgaatttgtcaatgatactcatcaagtatgcttggatcctttggtccttggatgcttctcagccaagtggcggtagcacagatgtggtgaacaatgacgaattgaggcagggaatagacctcactagccctttgcaatggagatcatcgttctagtggccatgtgaagaatggaaccaagggaggcacaattagaggcagagggaaaccaggcagacggctgctctttttgagttgagcttaactctccttgtctgaacttggtgatagcaatgggaacaaagtgggtagactaacagagagcattaagaagttaaatcaatctctctctgtctcctcccaacctctctctctctttcatccccttctctccctatctctcttttttttttcttctcctgtcccttcccatcccacccctttagactaccttccagtaaatcacactgtcatttggtgccacaagctttcagggtagacactgatttttcccccctaatatctgctctctttcaaaaggaataattcaaaagacttaggacaattaccactgaaacacttcgagctatttagctaaagcccaccaaaccaaaacaaaatactgatttttttttttttttttggtgactctgttcatacagtgaataaagatctatcaaaggaaaaggaaactgagaccgaaaacttagggtctaagttgttctaaacccagggttctcaaatgtgttgtacaaaaagtttcatgtaataaaattaagcaaataaaacaaatgaatagaggtccaaaa

SEQ ID NO: 2639 - DNA, 4857 bp, Homo sapiens
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgtctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttg

SEQ ID NO: 2640 - DNA, 4713 bp, Homo sapiens
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgtctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttg

SEQ ID NO: 2641 - DNA, 3708 bp, Homo sapiens
atgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctga

SEQ ID NO: 2642 - DNA, 1751 bp, Homo sapiens
ggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcaggaaggttgctgcagccttggcacatccgtggtgtaggtcgggaggtccccaaggcccctgccctctagtggagacaaccaacaataaataatcacacaaagaaa

SEQ ID NO: 2643 - DNA, 2068 bp, Homo sapiens
atctggagccgctgccgccggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattcca

SEQ ID NO: 2644 - DNA, 2204 bp, Homo sapiens
cggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagacc

SEQ ID NO: 2645 - DNA, 1961 bp, Homo sapiens
caaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 2646 - DNA, 2147 bp, Homo sapiens
cgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaatgctttgccacca

SEQ ID NO: 2647 - DNA, 1976 bp, Homo sapiens
cggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagacc

SEQ ID NO: 2648 - DNA, 2061 bp, Homo sapiens
cggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagacc

SEQ ID NO: 2649 - DNA, 2077 bp, Homo sapiens
cggagccgctgagcgggccgacggccattttgtgaagcggcgaaggaggtggtggctgcgttgggctccgggaagccgttcgggctggggctgtcggccgcggggcggaggcactcgcgcggggggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagacc

SEQ ID NO: 2650 - DNA, 1070 bp, Homo sapiens
gagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccc

SEQ ID NO: 2651 - DNA, 673 bp, Homo sapiens
gctgtcggccgcggggcggaggcactcgcgcgggggtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggaca

SEQ ID NO: 2652 - DNA, 821 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccag

SEQ ID NO: 2653 - DNA, 831 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgg

SEQ ID NO: 2654 - DNA, 400 bp, Homo sapiens
tgagcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccg

SEQ ID NO: 2655 - DNA, 826 bp, Homo sapiens
cattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaag

SEQ ID NO: 2656 - DNA, 751 bp, Homo sapiens
ggaacgcggagccgctgagcgggccgacggccattttgtgaagcggcgaaggaggtgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttgg

SEQ ID NO: 2657 - DNA, 746 bp, Homo sapiens
ggaggtggtggctgcgttgggctccgggaagccgttcgggctggggctgtcggccgcggggcggaggcactcgcgcggggggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctg

SEQ ID NO: 2658 - DNA, 2187 bp, Homo sapiens
cggcccgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcataa

SEQ ID NO: 2659 - DNA, 2308 bp, Homo sapiens
cggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgggaacttggcccagaccctccccccctgtggccctctgggtcaccatctgtgaaatgggctgatgttccggggcctgcctcctggagaatggacacagcatgaaggcgtggttttatggcattccgcctggcataggtccagactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatc

SEQ ID NO: 2660 - DNA, 2185 bp, Homo sapiens
cggcccgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcat

SEQ ID NO: 2661 - DNA, 2564 bp, Homo sapiens
atctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgttt

SEQ ID NO: 2662 - DNA, 2120 bp, Homo sapiens
aatgctcaccctgactcattcagggaaggatccaaggtttttgatgcagggcactgactctctgcctgtttttccccttcatcatctgctccccttaaaaaatggtatcaactgcattgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctga

SEQ ID NO: 2663 - DNA, 561 bp, Homo sapiens
agaagggtacaaatcttttttctttctccaaggagaatcttttgagcacaatgaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaag

SEQ ID NO: 2664 - DNA, 5431 bp, Homo sapiens
acaccagcggctggacattgagaggatcacagcagtggaaaaagacacaagcacctagccgttgagaggaacgcactggcctaagaacatactgacagacgccggtaggccagcagggcggcaggccatcaacccgcggaaggacacggactttggccagggcggtataaggagcctaaaggacgtcatacccatgggccagacctaacattcctttctgctgatcccaagtttttagacaaagtttcccttccttaaccaattgcgaatcagaaaatcctcgaatccaccaatgacctataccagtaaagatgtcatctggccaatttgtgtgaaaaaagagaataattctcatccaaaccgcctgtctctggaaataagaaaagctctgagggtctccaaagttaccagaggaaggctgaattttatggtgattgataatatttccaagcttatggagaaaaaaatatcattagtcttttccatggtagaaaagagtaaagcctgtaacaaaaaaagtgatacagtggatgggatgatgagacccttgaaataagcaaggatggaccagaaactggtaacactcacccatggaatttcattatgaagtcgtggcaagggccaagccgacctggatttgaaacccatctcttcaacgatgtagattttgacaacatatttgatttctctgggcctcagtttgttatctgcacaaaagggagatatgagtggttacgttattggattgtcatgaacattaaataggataatgtcaaatcattcagccaagtttctagcatatagtacaggttcaaatattatcttttttttcccaccaacctcttttccaggaaaatgcaaagctactctttagccaaattttaaaacaggggatatttattttgggaatcattaatacccatctgccccttttttggtccattggacatattgaaatgaatgattaatacttatcacttcatggtgtacacattgttttgtttcttatatccagagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactcccattccccccacacccgcgccgcgatacgaccgctccaccctagagtggagatggagaccaagcacttggagatctaaatcaagtgtccccaggagctcagttgagcgacaaagctgagcagaaagcccagactgcgggcgcggcaggaccacggagagcgccgccgccaaggcctgggcggggcctgagctcgggttcccggggcaatgctcgtctccgtcagcaacccccagggggcgctcgcgcggaggtttcggaaccagtctcttgccgggttgctgggtgcatgggattcgtcagaaggtggaaatctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattct

SEQ ID NO: 2665 - DNA, 2230 bp, Homo sapiens
gagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgcta

SEQ ID NO: 2666 - DNA, 3489 bp, Homo sapiens
accctcaacccccatccccgcctgacgggagctagccctcagtccgcccgagctgtggttgtgggcgccggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtggtgaatcccaaaaagaaaggaaaaaagaaaaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacagatttttaaatttagctttatttatcaacccaaaaaacaaataaataagatcaatattcttttcttcttgtcaaaca

SEQ ID NO: 2667 - DNA, 5291 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 2668 - DNA, 2332 bp, Homo sapiens
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttatggagcagctgaagctgtgataagacttctgagcttgcttctgaataccacagccccgggcacagcaaagccaagaaccctgtggatgagtgagggccgcagttctctacacaatcctgaaatcaagtgttcctgtttctcttcctcctccccatttccccagtcactgctcagccttctcttgggtctttcaagcatttgtgaatgcatgtgcacacttagacacacacacgcacacacacacaacccatcttgtgtcttacctacctctgaaatattggcatttgggagacaatccctaatcagctaacacttgtttttttctatcctctgtgtgcttgttagaatactgtgaaggtgttttctatggaccgacttctaaatgttcctcctgaaatcagtgttattcacacagttctaatgtaatgaattctgtctgtctgaaagcttgccatattgtccctggtttctcccagctaatagagaggaaaatgagcctgaatatgaacccgtcaccacagaccgcactgcatcctttccaggcagcagggccctggagactgtgctcaggcctggcagcctctgtgtttcacttaggcttgttttgctcaacccaggcaagacttttaaaattgtttgaataagctgcagcatcagtatgcttttttaaattgtgatttaaaaaaaaatataaaatgtcccattccttccattttcaaatgcatacttcagtagatttaagtatattcacaatgctgtgaaaccgatctccaggacctcatcgtcctgcaaatctgatactctactcactgaacagcaactcccctttgcctgcttgtctttttgcgcctggcttatttcacttagcacaatttcctcgaagtttatccatattgtagcatataacagaattcccttcccttttaaagctaaatatctttcaagtatatgtatagaccacattttctttatccatccattgtcagtggacatttaagttgttcccgcttcatggttattgtgaatgatgctgcacaggtatgcaaa

SEQ ID NO: 2669 - DNA, 5555 bp, Homo sapiens
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctt

SEQ ID NO: 2670 - DNA, 4780 bp, Homo sapiens
ctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 2671 - DNA, 3785 bp, Homo sapiens
ctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatgattctcttcattattctgttctcttcattattctattcatttcttcacccatttattcactaaacagtgacatagtacttacttgatgctaggtattacaccagttttgtgggctataagagtgaataacaagcacgtgacctctggccttggattttactacctgtggctccccaggcacatgaaaagaagtaaagatggttccatttgataagtactagtcacaagggttgtacatgtgataaagatgccagaggttgtgaccaccatgtctgtgcagaggtgctgctggctcctctttgagtgtgagatccctctgcagtcacacaacctcacccagttacgaagagctagtcacctcaactgcattgtcccaagacaggcagagtaggtaaaaatagtcatatgttaaaattcaaggtttagataaaaagacaactagttcttgcttgctttgattaacttttattatgcagatgcatttgaactggagaagcttgtcatgtttctctctaaaagatgtttttaaatgttattgctcaaaatggaaaaaaaaaaaaagaatcagtaagtattcctgacatgtaggattgttgcctggctgatcacaatgaaaatgttagctatgactaatgaaggaattatcacaacttacattggtattaataataaacaaatataagccaaagctatatataaccaatttagtgctatgtattggtgaaaaaaacagaaagttacagaaattactcacaatgaaacatagaacaagttagaaagggccttttttttttttgaaataaaggacttttgtctgataagtagcagtcatttgacctcaaatcattaaatggggaaagtctaaacaagaaaaggtaatgtttacctgaatgttggggaaagcattaggatttatggcccagacttaaagattgtagaagattgtatataattacagcaataagcatttgtgtaagaagtagctattatgctgaagaaagatgggcacacaaaatctctaggcaaatccttggaacaggggaaagtgatactgctcatagaattattggttcgagaggcagcaaatatgatgcaataagtatatcaaactcaattaaaaatagaggacagaggtatgtggtgggggaaaacaaatgcaatagggctaagtcagcttacagggggtgaatataatttgaacatggcacccccaatttacttgatcataaagttagccaaagacatgagtggtcgatctttgacaatactctagtgatctccatgagagatggcctgatagatgttggatagaatgaagggccatttgatgaacaagttttgtagatttacatgtgacttggcactgtgctgacattagagccttctaagaatcagataaattaattaggtgaaacattttttcccaaagcacttgcatttcagaaagtttctcatttctgactcagcttagaacccatcccttgttacaggtcatttctcctccttataagccatgtctgtttcttttttccatcatgtcatacaccctatccacaaaagatggtagctcacgttttctaactagagacgtgcaggcaagttgagagcatgaagaatcccttgggaataccaattctgtagcaaatgctaaggtaaaagaaaaactatgcattatttttcaactatagttggcttaaattcttagtttcaccctggagaccatgttgccagtggacaattgagcatgctgtgatttataaaatgcaagctagtttatatgataatgtttgccatctcactttaccagtactgttgaccttttcatatgattctaaaatcacttacttgtaaataaatactcctagttctgtagatgaaa

SEQ ID NO: 2672 - DNA, 1832 bp, Homo sapiens
aaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcattttt

SEQ ID NO: 2673 - DNA, 2826 bp, Homo sapiens
attgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctct

SEQ ID NO: 2674 - DNA, 2828 bp, Homo sapiens
acacagatgctgccacagacacacgcgagcgcaaatatttacacactgccacaccgaagaaatccatgcacgttttcctgcaaacgcgcgcgcgcacacgtacttcggcgggcgcccacgtcctctgtctcaccaacagacacagacatttacacttctaggccaggaaagcgctaaccagggccctgtgactctacgcaggttccagaacacgccttctacatttgttactgaaccgatcagcgaacacagacaaacgtgccaacacttaagtctactggctggacttcatctccatggcaacaagcatggaaggcaaagagttgattccagaaggaactgtgaagagccacaacaatgtgccagtgaataatgagtagtacctactgtggcaactcttcagctaagatgagtgtcaacgaagtatcagctttctcattgactctggagcaaaaaactggctttgcttttgttgggattttgtgtatcttcttgggacttcttattatccgatgcttcaaaatcctgctagacccatatagtagcatgccttcctctacatgggaagatgaagttgaagagtttgataaagggacatttgaatatgcactcgcgtgagagttccagctatatggtttttatggttgtgccatcgggacacattctggatacaattgtaactaccttgagggtgtgggagagaggctcattttgttcagtgaattcaataaacatctgtgactaatttcttcaccatgctgtgtaaatgataaactattgttgggattcctcactttcctctgttcccacttagaggtttccaatgaatagagcataaggatggctgccgccatgtttaccatctttattcttatcttgaacaactgccttgaatttctgcttcctttcttgtgctaataaactgtgccaaaggcatcttgctctctcccctctgaaaagcccaggcatcccctccacattcctgactcagacccctttagctttagtgagtcaggtcttaaacagagaatttagtccaaagaataatcaaaatattatttgtctaataataaccataggcccaaaaggttcacaggtgaaaaaatatctcaaaaatctaacacccaaagcctacaagtagtcacaggccctaaagctccccaaatttcacagagccctgaccctcctatctcttctgtttgtcgaatctcttgcagtaaaatcccatagcttggaatccaaaccagatctgcctcatactgatgctccctcccctaccccttgcataaatagaatttaaaagggagtttccagcatgacctagtggaaagagtactctaagcagaaacaaagacagtctcagctgtgccaccagtagagctatgctctaatgggtaagtcatctaatctctgtgagcttcagtgaagagtagtgttaacatccttttcaattctagtgccctatgaatgctacaaatgtatctgaaaacccagagatctgaaatgaatgaggatttaagatatcatgaaaagtttttcagattaggagcctaaactcagagatttgaattctaatgttagcttagccaagaactagctttatgacctagaaagttacctaaagggaacctatattgcacaacaagaattaagaaacccatcctgcatgtcttcagcaatattgagagggccaattagatataatgaatgtgaaagcattttgtaaaccataaaacagtatctaaacataccttgctatcaatatttattgtcctcatcagtagcagtaatagagattctcaaaccctaagaagcaatggcttagtgtaaattattcaatctctctagtatttcattctcttcaattgagaaataaaaagataaaattatatagttctaaattctttccaactacaaacttctgactctctatgagtcagaatggaggaacatagcaggagataaatacaaaaatatttatgtcctttgaaaacacagaactgcaaaacataccatgaaggaacaagactaatattaccaagaggtagcactaagttagttactttcaatttatttgatactcttataaattctttgagttggagactactatttccattttatttttaatcttaattttgcagaagagaaactgaagctaagagaaattaactagcttcccaaggtcaccatagctagggaatggttatgttagggattgaacttgggcagtttgatttctgctgtatccctagacactgtcctcaacacttctacatagcttataggcatggttactgctcaggtctatggaattccaaaaccagctgtctctgtgagattccttgatgctttccatctcataatagatttagaacatatctgttattagctatggatcttctggaccaaatcctcacctcaaggaggctctctgtaccccagttggttcaagagtgtaggcctggtacacctcatagccagttagtaacttggcccaagaacaggccactgggccaagttcaactgaacatactgaaaattgtgtgtgccaggaaactaggtctctttgttgaccaaggcttttaaagtaccagatgtttcatttgtctcccagagaagacacccaccaagaccctccattttgatgactagaacaaaccaaggccagatctttatttcaaaggaagaaagacctctacaaccaagaaaactttatgaaatatgagcattgtttctggaagttcaactcccataagcttttcaagtatattaactctaccataatattatttccaaatccactaaagaaaaattctattaaccaa

SEQ ID NO: 2675 - DNA, 691 bp, Homo sapiens
acaaacaacgcagaatgatgatgatggtctaggtttctttaatgagatatctggagaattttcagaccaggtttcccagtgcgttggaaggattgagtgtcagagtccttgagccatccaaagattctcttaagagagaaattctcttaaggttgaaatctgagggtttaggggtggattctggcagatcctaaggtctgggatctctggaaagccctgaaatttatgcatttcaccatgatgaagacatctaggcaaagagttgattccagaaggaactgtgaagagccacaacaatgtgccagtgaataatgagtagtacctactgtggcaactcttcagctaagatgagtgtcaacgaagtatcagctttctcattgactctggagcaaaaaactggctttgcttttgttgggattttgtgtatcttcttgggacttcttattatccgatgcttcaaaatcctgctagacccatatagtagcatgccttcctctacatgggaagatgaagttgaagagtttgataaagggacatttgaatatgcactcgcgtgagagttccagctatatggtttttatggttgtgccatcgggacacattctggatacaattgtaactaccttgagggtgtgggagagaggctcattttgttcagtgaattcaataaacatctgtgactaatttcttc

SEQ ID NO: 2676 - DNA, 1630 bp, Homo sapiens
aggagtaagtggagaggtagagggcagaagaaaaggggtcaagaaggcaggaccccgtgaagcacacctttcctaaggattttgacgaatgagaatgaagataaactgtgagttgaaagtgaaagagaaagcataagggatcttaggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacatagaaa

SEQ ID NO: 2677 - DNA, 1577 bp, Homo sapiens
ggagaggtagagggcagaagaaaaggggtcaagaaggcaggaccccgtgaagcacacctttcctaaggattttgacgaatgagaatgaagataaactggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacat

SEQ ID NO: 2678 - DNA, 5796 bp, Homo sapiens
atgctccgcaccgatgcaggagaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatct

SEQ ID NO: 2679 - DNA, 7671 bp, Homo sapiens
atgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatct

SEQ ID NO: 2680 - DNA, 7760 bp, Homo sapiens
ccccgcccccgcgcgccgtccgtgaggtccccaccggccgccgtagccggaactgctgctgagggcggcgggccggcttcgctagggatgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaa

SEQ ID NO: 2681 - DNA, 6881 bp, Homo sapiens
atgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaagacagacatcttccaaaggcccagctctggctgtctattagccgcgtgcctttcgggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcagga

SEQ ID NO: 2682 - DNA, 1119 bp, Homo sapiens
ggcgcagggagcagggagatgtagacctcattgacctctgtgtccaaatgtcggccaccccgaggtgcttccaggtttaagatgccatcatgggagagagcagctcggactcgccaggggtcgacatcagcaggcaggacataggtgcggcagaactctcgggacacgaagccgtggcggtccaggcgctgggggtgccgggcagacacctccagcaggttatccacagtcctcacagtcacctcgtctgggctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 2683 - DNA, 887 bp, Homo sapiens
aacagggagcactgaatttgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 2684 - DNA, 1017 bp, Homo sapiens
gggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataactgtcttgtgtttgaatattccacacacttttaaataaatatacagataccacag

SEQ ID NO: 2685 - DNA, 754 bp, Homo sapiens
ggcttagcacgcccgacagcactaacgctccggggccggcccagcaaatcttttgtccggggcggcgctgagccagcagggcgctgcccggtgtaaacggggacccgcggaaggggcggggcgcaccatggcgcagcgctcggggaagatcactctctatgaaggcaagcacttcacagggcagaagctggaggtcttcggggactgtgacaacttccaggaccggggctttatgaaccgagtgaactccatccacgtggagagcggagcctgggtctgcttcaatcaccccgacttccggggccagcagttcatcttggagcacggcgactaccccgacttcttccgctggaacagccacagtgaccacatgggctcctgtcggcctgtaggaatgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcagcatggagccctagaagcttcggagctgaggacttccagctgagcagctctcttcaatcagatcaaggaccggaagaggccaccacaaaaccagcaacaacccagccacctttcctgactgcaaacctctgagcctggaaccgattgacatgtaaatgcacctgcaccgtttctgagccgggagagtgtttacttaaaatcatgccctca

SEQ ID NO: 2686 - DNA, 1252 bp, Homo sapiens
gggaggccagggacctcactgggctgggcaggtgcaggccaccgccgtcccagtgccctcagaggcacctagactcatgtggacccggccgcagaccgttctgggcagctctgtccaggccggccctgccctctgacctggggccgcaggggctggccactgtgggctcggttccctgccaccccaattcatctgcaccccaaggaaagaaaatgaggggttgcagcgccccaggacccaagagcccccgaacaccagggcagcacatacttccagtgccagggccacagcagagaggggcgcaggagctgccgcggccaggacaaaccaacctcaggctgacctaggccggtaatgggtttaacgcatcaggtgcaaaagagaaacaccccacaaatcagggagaggagggaagccgcccaccccatgggaggaagctgaggagtgaacgccagggatgggcagggccggtcctcggagcactgcagacaccagaccaagggcgactgtcatcaccacgagaaggccccgtccatggcagaagccaacctcaccgcgccgactgcaccggagacgcccacgaggacagccggcctctgagaacgcagctgagccgtcacaggtcgccatcagcaaaggcaagagtccagattatgcaaacggaggcaaggctgccatggactccagagcctcagacgccatcaacaaaagcaaagtggacacatctgcatcaaatccatcacaaagacggccttccagactccgggggaaacggagtctcgctctgccacccagactggagtgccttttcccctcatcgtgtgggagccgccgggcgacatcccgccccggtttccctccactcgaaggcagtcacctcggttgccagctcctgcctctgtgatgatccccacgagggctgcagagtgaagggcacagcagggttcggcctaactccccggggagccctaggcgagagggcttggtcctggggagctgcccaggtcttctatatcccctggcctccatccagtcccgcacgactcagctcctggccctgtgcaccgggcgacgcctgctaggcgcatgaccctcagagtcaggcctgtactcacctcagcatctatcaagggccttcaaggatcgggtttttttaatcatcgtcaaatatatcgttactaaaaagatacgtacactttgggaggccgaggtgggaagatcacttgaggtcaggagtttgagaccatcctgg

SEQ ID NO: 2687 - DNA, 3860 bp, Homo sapiens
tgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaacgttgcccagttggttgttttagtattagacttttttttcaatgccaaaagatagaagattaaatattcttgaataaagcagtgatatatattggaacacttcaccccagcatttccccaggtgttgtttggaacactgatcttgtgaagtatttttgctccctttctattctaaccctcacctcaaaaaaaaaaaacaaaa

SEQ ID NO: 2688 - DNA, 2652 bp, Homo sapiens
cgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagcgcacgctctccgcccggggcaggagccccggcttcaggtaggggcctaggagggccccagaaatga

SEQ ID NO: 2689 - DNA, 2912 bp, Homo sapiens
gagtgcaggatatattagaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataa

SEQ ID NO: 2690 - DNA, 2762 bp, Homo sapiens
gacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataa

SEQ ID NO: 2691 - DNA, 2948 bp, Homo sapiens
atggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgcctcctggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 2692 - DNA, 3695 bp, Homo sapiens
cgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggtagaaaatcaaatggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 2693 - DNA, 3071 bp, Homo sapiens
aaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaa

SEQ ID NO: 2694 - DNA, 6828 bp, Homo sapiens
ggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaagtgtttttttggttgttgttgccgttgtggctgcccgcattccttccctcccacctcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacagaattcttcataaggaccagatctcttccatgtctgtgtcaatcacataaagctaaaatgtaaaggacattgaagcctttatttaattgtactaatatgatggtgttatatactacatcattagctagttaaggttttctgacctgacttctctttgtcttcctaggtatttatttgttatcttttaatcttgtgtatctaaattaacttagttaatagttacccaccgaataactatgccaagcaactagtaaagaatgtttattttatttccccttataggggaagagtggactgggaacaaaaatgtatgggccaaaaggccttagggttgtcattcattgactttcttattcctctcatgagctataattgagtatagtatttttttagtgctgatgtcattacttctcatgtcttcccctgagttgaaagcctacgacaaacatgtataaaatacatttaagaattttcagaatatgaaccacaaaactcagtatcttatatttaaatgctacttaagttattattggaatccaagtctcactaactagggtacatttttataaaatgtttctctgtatcttgaattgaaattacttgcccagaggcaagagttctggggatataacatgatttgagatcttttttaaaaaagggtggggcggcgggggagagagcgacaagtttatactagtttatgcttttgatattagtattttaagatacatcagttgatcccgaaacctgaccattagaattactctgaggagcttttaaaatagattcctggagcctacccctggaaaattgtctcgctggatctcgagaggggcctgagagttctggctttttttttttgtttggttggttttgttttgttttgttttgttttttctttaaagctctcctggtgattctaatagccagtattgggtaatcaatgttttagctaaatgtgacactggtttgagagtaggcaacaaaattaaagttcaccagacatctctttgtggtagagtttttttttttttaaactgggaccagatttcacagagcttattcaagatacatggaggaataataaagaagattaaggctactgctcattatcatttttgtctttcatattttttaagggtttgcatttctaggacttggaatagttgaccatatacatagctaaaggacatgtccctgaatgagaccattatatatattatctgtaaaatatttcactatttttttattttataaatctttgtagaaataagcaatgaaatactactttcatcttttgaaatgggatttttcaaggcagtgtccttttggcattaaggtaggggggagttaatattctctctgccttgtttccacgtgaatcaatattaaagtcatggacattttaaaatctcaatttaatttcttcttatttactatgcagtatagccgtgaacaagtaatgtagatttagttttctcatcttcaaatgccctgatcaccctacctcacagggttgttgtggggataaataaaacttttatggaagca

SEQ ID NO: 2695 - DNA, 4659 bp, Homo sapiens
cttaatcgacccagtactaaggccttgtgttcagtttttctccaggattcagactagagagtttcttccggcgtaaggaacttcaacgctcttcacggaagtaaaagtgtttttttggttgttgttgccgttgtggctgcccgcattccttccctcccacctcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatgcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaa

SEQ ID NO: 2696 - DNA, 4255 bp, Homo sapiens
cacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatgcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaa

SEQ ID NO: 2697 - DNA, 591 bp, Homo sapiens
gtgcggtgcagcaggtcggtaggcgggaaatggcgactggctgaaggagctggttctgttgctgctgcgggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctc

SEQ ID NO: 2698 - DNA, 1895 bp, Homo sapiens
gccgccgctgcttccaatctcagtcctcctcctcttccagggccgtctgccgggatctcctccccttctaaacctggtcctccagcggctctggcgccttgttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtt

SEQ ID NO: 2699 - DNA, 583 bp, Homo sapiens
agtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttaggttgcggcctgcgttgtgatttctggggttagatttcactttgctacccacccccactccgatctcaagttcctagtccccaacctctggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaac

SEQ ID NO: 2700 - DNA, 575 bp, Homo sapiens
aatctcagtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatca

SEQ ID NO: 2701 - DNA, 772 bp, Homo sapiens
tcgacttcagcgagaaactgtgcggagctccagcagctggacttcctggagcagaagagccgctgaaccccgcccctgctgatctcactgcacacagcctagggccccacccgccgaggactccagaaccttctcctaccagctcgcccagagaccaagccaagagagtggtctctgaggagcccgctagaaaggcaaggcgaggcccgcagagaaggatgccaagcctgtagaagcagagacgtcggggatgggggacctgccctgggcgccgccagaggcccaagcgcccagcaccgcaggagctggagacgtcgctgagcaccaggtggcgccggcgcggttcctacagggagcctggaggcaggctgcggggtggctgtgccgggagactggagcggctcctggctccgcgcaggcagggcccccagagacagctcatgcagcagatccgcagccccggggccctcaggcaccgccgcggctgccgccctcgctcagtcccgagcgcgtccaccctggccagccagctgcccccgctgaacctgcgccgggcgctccggctctccgttcgggccccagccaaccccgcgggctcaggctcccagttcctgtcccagcctgcgccggctccagcgcccccggctctccagctgctcttcccgactcctatccttggccgcccccagcgcggaaccgacccgcgaccctaccgccaacatcgcgggtctcgcctctcgcagcctttttggcgtccgcgcctcagcgttga

SEQ ID NO: 2702 - DNA, 762 bp, Homo sapiens
gcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagccctctcccctctcttccaccatctcctgctcggacagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgct

SEQ ID NO: 2703 - DNA, 2973 bp, Homo sapiens
gggatgctcttctactccaccacacagttcagatggtgccagccttggggtgggctgtggaccaggcagccactggcagtggaagagagacaggcagccccaggcccccaggagtcatgctggtgagatggtcagtggtggcatggctgaggtggggacggcagggcctgaggacctgcaaccttggatttcttggagacatgttgggctggcacaactgggctgccaccctgggggtaaagatctgcccagcccccaagcccagagatacccggcctgatctaggcaaccagtcctgggctccagagagttcctctggccccgaggacgtgcaatgtggggtgaagcaaagcagagaccaggacagaagattcacttcctcagacgatgaagcttactgtctctccaccgctcatgccaagagcctggacatgcaggtgggcatggataggaacagctgagtgggagtgtcagtggcactggagtatgcaacaccaagtgtgtacgtgcacaagctctaagtgagaagggcactagtgtgtgtgcaccaaagctgtctgagcaaatgtccacgaaaccacaggaggtggagctgagggatgctacatgtgagtgtgtgccaggggtatctctaggaacttgggaggggccccagtgtgtgtatgtgcatgtgggcttggccagtgtgacaatggatgttcctcgtggtggctgtgaacagccttactctgtatcaaccctccttccgccctcttctgggcgatgcctgttgcttgtgtgtggcagcagctgctggagccctttgcagagacctgggacctcaccacacccatacacggggacccaatgatggctcttgtggactatcacgatggcgtcatcgccagcacggtgactcccctgaagacttttttctggccagaggagcccatttggcctccacaaggggcaggaatgaacattctccaaagggcagcctccaaaaatgtctgctgagcatcagggtacaaacaacccgtctctcccacctgagggcgggcgtcactttgaggtgcgttctactctgtgtctcagagtcaccagtgggactgcgctcagtggcctgcagtggtgacctgcttggtgaccccctcactggcttccttgcctttcttgtttcctgcctcactccatctggtactcctgggaacacttccctaaccaaactctcacccacatcctcatcccagggtctggccctggggcccctgtctccatcgtcctgtgatgcagcttcaccttccatctccttgggcctctgatgagcccaggtacctggggtgttctccttggcccctggcacagacaggcggcatctccttaggaatgtgcaaaggaccttgaatgtggtgccatatgtgacacaccacagcatagggcatgtcgtggatggaggagcaggaaaagccaagagcgtgacagtcccaaaggcctgtgggatcctaagtctttgtggtgggagctgggtgtcggtgtggggtggtttcggttgggggcagcacatggctggacaccatcactgtggaagtttctgcattcattcccaggaggtggagccccagagcactgaggtggcaccagagccatgcctagtgatgttcagaacagagggcatgcaaaatgattattttgcttacagagagggggacataagtgtcaggctttgtccagagagtgatgctggcggggcgggggtgagccccaaaaatggaatacttgaatgggttcaacctcatagaacatctcaagggtggaagaaaagcccagggttaaaatgacgggttttgtctgcaattatgagtgctggtgggtattgtgtttcaaggtgagaggaggggcttcctcattcttcagggcctgacttgttcactttgagcagtggcagcagcgagccggcaggtggcagtgtgggctcagggtgggggtgataggcgcagcagagccagccttggcctgtccagcagggacgtgggctggagaaccagaaggatgagcctatctcgtggtctttccccccgctgcaccctccttcaggattgcaccccactttcaaggcacttggggtctaagactatattaatggactattcgaattttggattgcaccccactttcaaggcacttgggggcatctaggactatgttagtgggctctattggagttctggtgggagggaaatgtgacagaggaaggggcccaggctctgtccgctaagagatcaatagcccaagccatggtgttgtggagggcatggaaaggaagaggggaattcctgcagagggtgagacaacagctcatttcagtttcattgccactttcctctctttcctggtggtacaagccatcagggtgctacaagccaactcctgttagagtaaaacgtgtagtctctgaagttcctagagtcaggtcctgaagttgatggcccatcctcatgacgttacaccagccatgtctcagagaaatgatgccaagtttcagtgaggttaaaaaaaaaaaagcaactcctgtaaggcactgactatccaaatatccacatcaacaggaaaatgacaaggcttcaatggtgcttaatcttgagaggtaatgaatgggtagagattgctagccggaggtgtattttcattttgttgctatttagtgtttccttttcttacaagtttcagaaggtataaaccctactcgggaggctgaggtgagaggatcgcttgagaccaggagtttcaactagcctgggcaacatagtgagaccctgtgtttacaaaaattcaaaatcaaaaattagctgggtatggtggtgcatgcctgtagtcccagctgcttaggaggctgaggtgggaggatcacttgagcccaggagttcaaggctacagtgagctatgttcataccattgcactccagcgtaggcgactgagtgagaccctgtctgaag

SEQ ID NO: 2704 - DNA, 1359 bp, Homo sapiens
gccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcggcgatccgggtcgggctacgagggcagcaccagctggaaggcggccttggaggacaccaccacacgcctcctgctgggtgccatcgcggtccttctgttcgccatcttggtggtgatgagcatcttggcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcaggcagggcccctgctgtgtccgtggtgctgttgtattggtcactaacggaataaagagttaatatctc

SEQ ID NO: 2705 - DNA, 2275 bp, Homo sapiens
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgc

SEQ ID NO: 2706 - DNA, 2608 bp, Homo sapiens
actggcaggccctcgctcagcctttggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgc

SEQ ID NO: 2707 - DNA, 2193 bp, Homo sapiens
aagtgtggccacttcctcttgcctggcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgttccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctcccttt

SEQ ID NO: 2708 - DNA, 1888 bp, Homo sapiens
ggccccgccgccaccgctgcggattgcagcccctcccccgcccggcccgcggcccggcccctgcggcccgcgcggagcggacgcgcgtggcgctgcccggtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctcccttt

SEQ ID NO: 2709 - DNA, 762 bp, Homo sapiens
cttcctggggttgtttctccgtgtgacgtgtggcctttgagatcaactctcctgtaccagcgtaggccgcatgagtggggggcgggctcccgcggtcctgctcggcggagtggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatcc

SEQ ID NO: 2710 - DNA, 937 bp, Homo sapiens
cagccagcaagtggcagtttcgggttcacacggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 2711 - DNA, 1199 bp, Homo sapiens
acggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgcc

SEQ ID NO: 2712 - DNA, 870 bp, Homo sapiens
tgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 2713 - DNA, 769 bp, Homo sapiens
tgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgc

SEQ ID NO: 2714 - DNA, 837 bp, Homo sapiens
aatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 2715 - DNA, 1576 bp, Homo sapiens
ggattttgcttccgggtcgtaggcgctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataa

SEQ ID NO: 2716 - DNA, 2329 bp, Homo sapiens
ccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagttttt

SEQ ID NO: 2717 - DNA, 1894 bp, Homo sapiens
gtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagtcatcttggaaatgaaagcataatataaagactctgtaaaggagactcgagaagctctgagccaagatccacaccccatgttgaggaacactggttttccttataaattgctttatgaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcaga

SEQ ID NO: 2718 - DNA, 2633 bp, Homo sapiens
gattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtaatcccagctactcaggaggctgaggcaggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggtt

SEQ ID NO: 2719 - DNA, 815 bp, Homo sapiens
cccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagctttt

SEQ ID NO: 2720 - DNA, 2009 bp, Homo sapiens
gcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcatgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaa

SEQ ID NO: 2721 - DNA, 3278 bp, Homo sapiens
aattttcttgcggcttcttagctttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaa

SEQ ID NO: 2722 - DNA, 1110 bp, Homo sapiens
ccagataaaatctagaacagtcatccaataattaagccagaaagggagtatgaacaaacatgaagtaaagatgtttgtgagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactg

SEQ ID NO: 2723 - DNA, 2259 bp, Homo sapiens
agaattttcttgcggcttcttagctttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagataaaatctagaacagtcatccaataa

SEQ ID NO: 2724 - DNA, 1107 bp, Homo sapiens
gggcggggctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 2725 - DNA, 1594 bp, Homo sapiens
atttgcctctcaagcagcctctggtcatctatctgcctttgagccatcaagatgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagccggagtatgagcaatatcttatcagctcacgatacatttatgaagcaatatcctaaagtattcctgcaccaaaaacccagacttcctaaacttttcaaacaggaggaacaaagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatgcttagcaaatggagtacctttgggactctggaagttatgcctcagaatgaatcggaaacacagatgttctcggtggtgacagaagacgattgtgaaattcttaaaatcccagcaaagggatatgcaaagataaaggaggaaaaaataaaacttgaaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgtggcctagatctagaaacaacctcagtgaacattaattaagaaagtattgactaaataatggaataattgcattctggaatactatcaaactaccagcaatgaatttggtctattgtgactacatatcctggattccccaggaaagtcccactttcgaattgcctttcaaacacagtttttattagcagtctttcttggtttggatactaaaataaatatagttatcattgcttgattta

SEQ ID NO: 2726 - DNA, 1201 bp, Homo sapiens
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 2727 - DNA, 4509 bp, Homo sapiens
aggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 2728 - DNA, 4693 bp, Homo sapiens
gtggaagcatttccgtcattctgagacagttgggctgaggcggttggtcgcctctctctctctctctctctgttcctcatctacattttgattggtttatttttgtattgttttctttcagtttccgataggtggagaacattctgctaatagcttttcttccagtccatttgtggcttgttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 2729 - DNA, 4693 bp, Homo sapiens; identical to SEQ ID NO: 2728

SEQ ID NO: 2730 - DNA, 1201 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 2731 - DNA, 4509 bp, Homo sapiens; identical to SEQ ID NO: 2727

SEQ ID NO: 2732 - DNA, 1201 bp, Homo sapiens; identical to SEQ ID NO: 2726

SEQ ID NO: 2733 - DNA, 1201 bp, Homo sapiens; identical to SEQ ID NO: 2730

SEQ ID NO: 2734 - DNA, 2726 bp, Homo sapiens
gcgtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagt

SEQ ID NO: 2735 - DNA, 1361 bp, Homo sapiens
gtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctgtgcatgatttcttcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaa

SEQ ID NO: 2736 - DNA, 3330 bp, Homo sapiens
ccgcgaggctccgtctccccggcgcggcccgctcgccgtccggctcgctcagggcctgggcagacgcggcccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattagaggtgtgtcaaaaattaagttttgttggtacaagtaatataaagctacctacgtgctaacaacgatacagtttaatgattaactgaacctcttaactgtaaaacccaggagtcttggaaaaaaattaacataaagattaaccagggccactctcaaggaaagatggactgctgagccatagtttatggaattacttaagtggcattttaatatattaagtaaattcatgtaaatttatttgaaagtataagtaagctctacatggcgatttttagagttaaactagggctccacttgttaatgtgcaaaaataactggt

SEQ ID NO: 2737 - DNA, 1733 bp, Homo sapiens
gagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtacc

SEQ ID NO: 2738 - DNA, 2772 bp, Homo sapiens
cttcccctctcttcccctccctccccagccttccccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaagaaatccaaaagatccaaactttttttaaacttaaaaaatctctttgtagtatgtcagttgcactttttttctgccataatgtaacgtagcttgccccgtcaaaaattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtcct

SEQ ID NO: 2739 - DNA, 541 bp, Homo sapiens
aaataactggaatttgaaaggaggacagaggagcctccgctggagctagggggctccgttacagatccttttggcagaagttgacaattgggtatcaaaacagtggaaggtgtttcgggaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctga

SEQ ID NO: 2740 - DNA, 517 bp, Homo sapiens
gcatcccccagcccggggaacctcggggccgccctcttcgtcctctccggcccagacagacccgtcacctgcccacttgaaaacggcactactgtgttccttttcgggccagtttttctgtcagcgagtaacttttttttgtggcagcggcaaattagctactctatagtgcgtgttggaggctctacgagcccgtgttaatacacaaagaaggggacacacccccaccctcaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgta

SEQ ID NO: 2741 - DNA, 1622 bp, Homo sapiens
ctccctccccagccttccccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaa

SEQ ID NO: 2742 - DNA, 2355 bp, Homo sapiens
tataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggagcggcctccctccacgcggcgtccgcagcagtccccgtgcggccccggcgcggtacggcgccagccgggaaaaccgcagacgcggtccccgccgccgccccagagcaagctccgcggccggctccacagtcccgcaagccgcgcaacctggaaggcgacctggacgagcgccggctgctctgccacttgcagctggcccaggaccgcgaggcgcgcctgtggcggggcggcaaaccccaggatgaaatctgcgacgccttcgaggaagtcgtgctgtggctcctgcggcttcagaacaccttttacttctcccagtccacttttaacctggccctcaccatctttggccgcctcctgatttcagtgaaggtaaaagagaaatacctgcattgcgccacaattacttccttgaggctcgctgcaaaagttaatgaagaagaggagtttattccacaagtaaaagacttcacaaagcactatggctctgactattccccgaatgagctgctgaggatggagctggctattctggacagactgcactgggacctctatattgggacgccgctggacttcttgactatattccatgccctggtggtcctgagctggccccatgtgttggagctgctgcctcagaggaatccttccctccacgtcgcatccctgaccaggcagctgcagcactgtatggcgggccaccagctgctgcagttcaagggctccacactggccttggtcatcatcaccttagagctggagaggctcatgcccggctggtgtgctcctatatctgatctgctaaagaaagcacaggttggtgatatgcagtacagctgctgcaaggaacttgtaatgcagcaactgagaagtcttcagtcatcctcctgcacagacaactttgtgtcacctgccaactagcccctctgcctccaccccggggctttcagagcatagtgtgaaacctccttgcttggactaccatgagttctttggcttgttatgaatcctgtaaaaagggaaggtggctctggaagagcaactgagaaaaagttcccaactgagcccttggaaaaaaaataaaggggagaggggaaaggcaggctgaggtcagtagaggtcagggtggtctgatagactatgaccctgtcttccctttttctcctctgggcctgaagccagggagtatgaatgaatgttcaaatggcagcttgttttaccttccttctccagcaagggttggcattggcccctgggagcgctggaatatgaaaccaagaggcaggcctggctcagggctgaagggctggggctagctctgaccagttcttgctgctctacctgccagagctggccaggtccttccaacttcccaggcttatcccaaacacatatgtggtgcttccagtcccaactaccctgcctgccactcctcacatgggacagtctctgcagatgcatttacccaaccatggctatgacttatgtcttccctttacaaggactggattataaagtatgctttgtttaatgtaacttgagcaagctttaggcatatctttcctttgttactcttaagcaaagtggtttcagttattagtttaactagagggattttgtgctaatgaatgggtattataggctaacacctgtgatgggaggcacagctctgaatgctttctgttgggatgagcaggttctgaggccaagcctgctccaaccacagtgctgccaggaggaggagccggctgcctctctcatgctgtgctaccacagagccattctctaagcaggggagtgcagctgacaaagatgccagctggggctgtgtaagttgtgttgggggcatgaatgactgagccacacattcagaggtggtttgtgaagtcttccactgtgaactatggttttttttttttttttttttttttggtgtgtttgtgtaaatgtgctaagccatggggtgggaggggaaagatttactaggtgcaaagtggtcaagggccagatatactataattgtctatattatagagttagtatacatctgtattttttcttgacacacttttgcttgttggtgctttcgttaaaattacactttaattgcttccg

SEQ ID NO: 2743 - DNA, 3276 bp, Homo sapiens
aagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgcactcatgcctccctctgtttactttcatactaagggtacaaaaattccaagtctcttttgaactgtattttgtatgccaatttcatgcttatttttcctttatcagagagagttaaggtggacgagcatgccctttttgtcatatcagcctgaaaatgttaaaaagctaggtggagacagattagttgtttcatttttgtttaacaaggtatttatacttttagcttaatttcattaagaggaacatcaggcattgcaatcagtattaatcaggggctcaaatacagactatctgggtgaccttgactaagcatcaaggaggtagcctttatttccccttaaaattagtttaacatctctgttccattattcagatctacacaaacaaggcttcctcaacagctatctatttttactagagtctttttttaaaactaaaactaactctaaagaagtttcaacagaatttccacatacctgcattcattagaacttgattctcccagaatacaaagtactctattttaaagaaaaacccaacagtgcacccctgggcagttttcagactgcagcaaatcttttattacaaataattaaatctctccataatgtctcaaacagtatcaaacaccatttcatatctctaacacagagcagagtcggcattcagtataagaaccaagtgaaaagtgttaaatttcaagcatctgatcacatcacatggtgaccaggtaaagcttagatgtcattttcccacattatccaactgtgcatctcaaacatatcctcatctcagtaaagacaaaagtttctatttcatattgttaagtgcaggaagttgagagagataaaaatccagtgaaaacacatcaatctcaattcaactcagttaaaaaaaagaaaagcaaatttaaattagtttttttcagagaagaaagggaaaggagtccatggggttaagaatcaaaactgaccagggctggcaactatagatggcatgttgtagctctggaaagtatctgtcacatgatattttaaaataaagtggcttttgtggattttttcttttttggtattgtaaacatgtactgtttaatattacccgaatttaatttaaaacatgtttgcaaacaaaacaaaattaaaagcctttaaggcaaacctccccctaaggaaaaaagtcatttgttataaaattgtgaggacacccaagcaagaccccacttaagattcgtcagcatgaacttgagagcttttgtccactgctcctcagagttaaactgggttttgatggaataggagccgccactgcctcctgtgtcttcaatcttgcctttctccacatccatcctgcagatggacagagcaaaactcattagtaactgagatctgagttaagtaagttcggggcagggacttgatcatgggaccattcacgtcattttatctattaaagaacacttggtgaggaatgatagtgtattttggatttgcttgaaagccaaaaatcaagaagactgtcacaagagcctcattgtcattgcagagtacagggacaggacacacacccaaagagaagagaagcctggagtaggggtgagtgagggttacagtacttcttgctgttttcctaggcatccctgaacttggcgggggagaaaggaggcagaagaaaagaaatgctttgttttggggtgatagaagcagccttactctaagtaaaaactagagtttccatccatcaatgggatcctagaaaaatcaaaagaagcattcctgtgtatttccaagggcttcagggaaaaaccttcttgaaactggagaggaggcttgagctctatgccaagaaaaccccctaaaccatctaaggcaacattcttctactccaaggactaggtggtcacattctgtcctgcttgcagtactgggtcagtctctgcccatcaatgtcatgtgattctgtgccatttttttgctttcccaccatttatactgttttgcctccatt

SEQ ID NO: 2744 - DNA, 2369 bp, Homo sapiens
agagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgcactcatgcctccctctgtttactttcatactaagggtacaaaaattccaagtctcttttgaactgtattttgtatgccaatttcatgcttatttttcctttatcagagagagttaaggtggacgagcatgccctttttgtcatatcagcctgaaaatgttaaaaagctaggtggagacagattagttgtttcatttttgtttaacaaggtatttatacttttagcttaatttcattaagaggaacatcaggcattgcaatcagtattaatcaggggctcaaatacagactatctgggtgaccttgactaagcatcaaggaggtagcctttatttccccttaaaattagtttaacatctctgttccattattcagatctacacaaacaaggcttcctcaacagctatctatttttactagagtctttttttaaaactaaaactaactctaaagaagtttcaacagaatttccacatacctgcattcattagaacttgattctcccagaatacaaagtactctattttaaagaaaaacccaacagtgcacccctgggcagttttcagactgcagcaaatcttttattacaaataattaaatctctccataatgtctcaaacagtatcaaacaccatttcatatctctaacacagagcagagtcggcattcagtataagaaccaagtgaaaagtgttaaatttcaagcatctgatcacatcacatggtgaccaggtaaagcttagatgtcattttcccacattatccaactgtgcatctcaaacatatcctcatctcagtaaagacaaaagtttctatttcatattgttaagtgcaggaagttgagagagataaaaatccagtgaaaacacatcaatctcaattcaactcagttaaaaaaaagaaaagcaaatttaaattagtttttttcagagaagaaagggaaaggagtccatggggttaagaatcaaaactgaccagggctggcaactatagatggcatgttgtagctctggaaagtatctgtcacatgatattttaaaataaagtggcttttgtgg

SEQ ID NO: 2745 - DNA, 1817 bp, Homo sapiens
tagctgcaagggtcggtgcttggcctcgcccgcaacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggtgtgccgcgtgctgcccctgagagccctgccccgcgctgtgaccccggagatgcgcgccctggtggtagactggctggtccaggtgcacgagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggaccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccacttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctga

SEQ ID NO: 2746 - DNA, 517 bp, Homo sapiens
tagctgcaagggtcggtgcttggcctcgcccgcaacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgaggaaactgaggtccggaacttggggcctttccagggcagggagtaa

SEQ ID NO: 2747 - DNA, 3767 bp, Homo sapiens
gtgcggccgaggcccgagccctgcccggggccgggccgcggggcgggcgggcgaaccgcgggcgaggcggcgtctgcttgcgcggtgcagccccagcgtagcccggggctgccggtgccggccgcgccattgttgggggagggggcggctgttgagggcggcggagtagggggcgagcgaaggcggtggcagagaggagcggaggcttcccatggggaacacgctgacctgttgcgtgtcccccaatgccagccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgttttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactacactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 2748 - DNA, 2619 bp, Homo sapiens
ggcggcgtctgcttgcgcggtgcagccccagcgtagcccggggctgccggtgccggccgcgccattgttgggggagggggcggctgttgagggcggcggagtagggggcgagcgaaggcggtggcagagaggagcggaggcttcccatggggaacacgctgacctgttgcgtgtcccccaatgccagccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccattgtgaccttagcaatatattaccacataaagaacagcgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgttttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactacactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatgg

SEQ ID NO: 2749 - DNA, 1952 bp, Homo sapiens
gaggagctccagccgcgctctctcccggcagtggctgtgcttcacagcgcttgttgggttccccaccccttttaaataagccgggctggtcaccgccctcgcagacgagtcagcttaagggaggcggcggcagcgcggcggtggggccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagat

SEQ ID NO: 2750 - DNA, 1086 bp, Homo sapiens
atgggaaacatactgacctgttgtgtgtgccccagggccagccctgggttgcaccagcaccagggattggtgtgtcactgtgagtctgagatctatgaggcagcagctggggacctgatagcaggagtgcctgtggctgctgctgtagagcctggtgaggtgacttttgtagctggtgagggcctccacatgcaccacatctgtgaacgggagatgcctgaagatatacctttggagcccaacccttctgaccatccaaaggcaagcacaatattcctgagaaaatctcaaacagatgtacaagaaaaaaagaaaaagcaactatgcaaagtatctactgagcattttactcaacaatacagttcatgttcgacaatattccttgatgacagcatagccagccagcctcatcttacaatgacactaaaatcgtgtgaccttggcactatattatcatatcaagcaaagagagatgcacatagatctttgggcatatttgatgaacagttacacccacttacagtgcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctga

SEQ ID NO: 2751 - DNA, 863 bp, Homo sapiens
atatacctttggagcccaacccttctgaccatccaaaggcaagcacaatattcctgagaaaatctcaaacagatgtacaagaaaaaaagaaaaagcaactatgcaaagtatctactgagcattttactcaacaatacagttcatgttcgacaatattccttgatgacagcatagccagccagcctcatcttacaatgacactaaaatcgtgtgaccttggcactatattatcatatcaagcaaagagagatgcacatagatctttgggcatatttgatgaacagttacacccacttacagtgcgaaaagaggttttggaggaatattttaagtatgatcctgaacacaaattgatcttcagatttgttcgtactctgtttaaagccatgaggctaacagctgagtttgcaatcgtaagtttgatttacatagaaagacttgtaagttatgctgatatcgacatttgtccaactaactggaagaggattgtcttgggagccattcttcttgcctccaaggtttggagtgatatggctgtgtggaatgaggactactgcaagctctttaagaacattacagttgaagaaatgaatgagttggaaaggcaattcttgaagctaattaattataataacagcattactaacagtgtttatagcagattctacttcgatcttcgcaccttggcacacaacaacggcctgtattcaccagtttatcttcttgacagagaaagagcttggaagctggaggctttttcaaggatggaacaagacaaagttttctacagtgctgccaagaatgggtctctgagtgcagatgatttaattcatcttcagcgtgctaaggccatcctcttctga

SEQ ID NO: 2752 - DNA, 1032 bp, Homo sapiens
tcctgtgtagtcattcagatacctccatggcatcttgatagaaaatacggctcatgttccaccatattgctagataacagcacagccagccagcctgaccttagacatacattagaaagatatgcaaatagatctctggctatttttgaagagccagtacatccacttccacaagagaagcttccagggaaatccttcaagcatgatcccaaacgcaactgtattttcagacatttctgtactctttttcaagtcataaaactaacagctccatgtgcaattgtagctttggtatacatcaaacgacttctaactagtgctaacatcgatctttgtcctactaattggaagaagattgtccttggaaccatgcttcttgcctccaaggtttggagaaatcatggtctgtggagtgtggatgacagccagaattccaaggacactgcagttgagaacatgagcaagatggagaagtgtttcttggagctacttgagtttaatattcatgtgtctgccagtgtttatgcaaaatattactttgacctgtgtgccttggcaaatgaccatgacctgtattttctatttagctttcttcacaaagataaagcccagaaactggaggggcataccagtcaacacagcctttctctgggaccttgtagggtaggaatggaaaattatgccacctactccccactctcctcacagcctgtactgggggccttatcactggcagaagtcttaccccaggagatcaagcaggagatccaccaggtgctcatggaccatggagtcccatgtcattacacctgcttcttgctgcacccagaagacagcacactggagcgcttcttagttctgcacagcatccaggggctgcaagaggactcagtgctgtgcaaggtggagatccatggcctctcaccacaaccccaaacctaccagagccacttccgaagcccttccctagcagagctgcttaaccgtatcagcgggacctgcagaaaccactttgcaggaatgcagaagtaa

SEQ ID NO: 2753 - DNA, 1635 bp, Homo sapiens
tgtggccagaacaagaaccttaactgtgccaaattttattctattcaataacagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaaga

SEQ ID NO: 2754 - DNA, 1584 bp, Homo sapiens
atgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaag

SEQ ID NO: 2755 - DNA, 1780 bp, Homo sapiens
agataaggcccagactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaag

SEQ ID NO: 2756 - DNA, 2240 bp, Homo sapiens
gggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgagtgaagcagctgcgataattatgctgtcagcctcgggaagctaatgaggagtcaccagagtggaaggttttgcatttgtgagattgctgaaggagagccgcgctgcagcttttttcgttttttatttccctttctttctttcttcctcctttttctttttctatgagttgggaaggagagtctggcagtccacagccaaattggaatccttttgattaaccggttgccttcccagcatgttctgccagatagtgtctctctctctctccctccctccctgcttttgaggagctgctgcttttgaggggcaaggaagccggagggaaatcccagcttttcatgccactgtccccaaggcaagaggatacttctccccgagagaagttccccaaatggtttggatttgagttgatttgagaataattggtaaagtatacgcactgtttattttagccatttaactgtctatgctatgacaagatctaatagaaagtagaatacaaaattgcatattataatatccgtgtgaaaatgtcttatgcatatcaacaaatggtatgatggctcccctttccagcctatttggaatatgcgattccaaatacaagacaacgagaccccagattacccacagcatttaagggcagaagtttaggccaggcgaggcagagctggcaagtttatttcttccctttgggtgtgagcagcttccagcaaacagtattatttaaggcattttatgcttttggtgcagtaataacagaaggctctctttttgttaaattgtgagatattttgagcaccccagatttatgcaaattgtgaacctgggaaaagcaatgcccaagtggaaaggggccctgagtaaattttgcggatgtgctttggtgacaatgtggctgctgcctcttgctatttttctcagatatctgtgctaatacttgtaacaatggctaccatttattaaaaacatattgtgtatcataaactaacacaa

SEQ ID NO: 2757 - DNA, 3659 bp, Homo sapiens
ctctggcaaaaagggagagaacaaggataggagaggcagtgggggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaagagggcttctgaataacttcattcattttggcatttgttaagagattcctgggctagaaggttgatttcccaaaaagacagataagagactgacaatttaaaagaatctggagacagagctggtgcttacagagacctgccactcctgtgttcacttacaatttctcccaacaaaaggatttctgtggcaaggagaaaactagcctaaagtttagaaaaagatggtttcttggataacattgttaacaaaaggacttcctgaggactatttattattattttgtagggggcacttcctccttcactaaactggattatcagaacgtattaccacccaacccatattttagaagtttggatttggctgctgattagaaatgaatttcaggctatctcctcctactgaatcttaattgtctgtgatgatggcaacagtgatggggaatctaagcgctggtttgatggtggagatattgaataagtagttgggagcagagttccaaagatgtaatttaagccctgttgcaccaccacacacacacacacacacacacacacacacacacacacacccctcaagtaaaatgagagatctgtcttagctaacacgtgtgccgttttatacaatgactccttctaaaagcagccagggaaactcaaatcgcttctgtccagggatcatctcaggaaatgtagcagcctagaaaccagagacctctgtatatcctttggaagagcaaggaggaactaattaagagataattaaaaaatagtaactatcccccaatgtctgagatggaaaaaggaaaaagacacatgggtagcccaaatcaacctgcctgagtaagtatctgattttagtaaggcatttgacaaagactgtccagctatacctgaaagatgaaacagtgtaggctgggtgatggagcagatatatgtactcaaatcatggtgtttatttaacccagagaaaggccagccgtggtgtgctacaaggttcagtcttgagtcctattctggtcaaatatttttattaattactcgaataaatcagagtacatggacaactttatacaactccttgaagtaagtactattattattaatttatgacttccatttcacaaaagaggagactgaggctcagtgaagttaggtaactccttcatagtagcatgccagagtgaagatgcaaacctcagacctggttctccaatgttcctgacacctatcgaatttagagaatacacaactcttgcagaggcagctgctatttagtattggatcatgattcaaaagacaccttgctagaagccaatgaacagcaggccaaaacaacacttacttgcatcaaatttcatctgacttaaattcttacactttgggctacaacttaaaaaaggctatgacttagtggaaattggcacttttaagtacaatatgaattaatagtataatttcgctgtcccccagagataatgctagtaccaatcgaaagctcagggatgctactgttgacgcatcagcaagagttcttgagcagttttacctgtccatcaatacaaagagttcccacaacagtagtgggattcctctgcctctctgaagatatgagagctataggagggattcccatgttggaggttagaagagctgacctccaatgtcccgtctaattccaagattctccaataatgactttggaacagctgtgtacagattatacttggaattatgcttagatactattgctgcaggaatgaatagacaaattttgttattaaaaaattgattttattaagtggaagttgacagaattatcctctttataatggaggaacattatgcttatgcatatgcatataccttatgcatatgattatgcttgtgcttccttctttaatggatttacctattcaaaagcttaataaatgttataagactctaaaacatttaaatctttcatttctcaattttatcaaataaacattcctggaatttgtgcata

SEQ ID NO: 2758 - DNA, 3016 bp, Homo sapiens
tagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 2759 - DNA, 3144 bp, Homo sapiens
acccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 2760 - DNA, 3158 bp, Homo sapiens
ggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 2761 - DNA, 2022 bp, Homo sapiens
gatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttc

SEQ ID NO: 2762 - DNA, 785 bp, Homo sapiens
taccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaacc

SEQ ID NO: 2763 - DNA, 991 bp, Homo sapiens
cttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcggtgaggagatagacagtaaagactaaagaaaccaataaatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgt

SEQ ID NO: 2764 - DNA, 943 bp, Homo sapiens
gcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagc

SEQ ID NO: 2765 - DNA, 601 bp, Homo sapiens
gaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgt

SEQ ID NO: 2766 - DNA, 2968 bp, Homo sapiens
gcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 2767 - DNA, 2028 bp, Homo sapiens
atgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccggtctctttgtccttgtggcagacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttc

SEQ ID NO: 2768 - DNA, 4157 bp, Homo sapiens
gcgggggtggggtaagctcccgcggccggtcgcttttctccgccgccgctggttggatcgtttcaataaaagtgttttttctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatata

SEQ ID NO: 2769 - DNA, 2442 bp, Homo sapiens
ctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggtgtgtttgtcataaaccatttcacgtgtcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctggcttgatcactgcacacgccatccctggtacctgaggcagaagacacatcttgtgcttccctagtcatcaggttcatcacttcgaagcatagaagctgtagactgaccccgtcaacagaa

SEQ ID NO: 2770 - DNA, 626 bp, Homo sapiens
aaagatcagggcagcctcctgctggcgggtcacaccccggagtgttggtcaagagcggaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagct

SEQ ID NO: 2771 - DNA, 566 bp, Homo sapiens
agtgttggtcaagagcggaggtagagggaaggtgggaaacccagcaaaccgatggggaggggaaaatggggggaggagggtgcctagtgctgtctccgtcgcagttgcttttctcagcatttttgtgcccgatgctatgcccgatgcttttgctccccaactcagctggatagctccagattccctccctcctgtcacccccacactgccacattgactctcctgtggtttttccctcgttctccccctacttttcacccactccttttcgggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgccca

SEQ ID NO: 2772 - DNA, 583 bp, Homo sapiens
aaagatcagggcagcctcctgctggcgggtcacaccccggagtgttggtcaagagcggaggtagagggaaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttg

SEQ ID NO: 2773 - DNA, 3141 bp, Homo sapiens
cttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaagga

SEQ ID NO: 2774 - DNA, 949 bp, Homo sapiens
tcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgc

SEQ ID NO: 2775 - DNA, 1648 bp, Homo sapiens
tttccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctga

SEQ ID NO: 2776 - DNA, 3961 bp, Homo sapiens
agtagagacagggtttcaccatattggccagtctggtcttgaactcccgacctcaggtggtccacccaccttgacctcccacagtgctgggattacagacatgagccaccgcgcctagccactttgaaagattttaaatgggcaagcgacatcatcagaaagcagctgagaaagttaagtctaggacgctgatggcagttggattggaggccaagtattattctcaattagcagcaaggaaactgaggcatggggtgttttttcaggtcacagctactaagtggggtttcttccatgacaccaaactgcagagaattttggagagcaaggctagacaccgtgtgttcctcactgcaggacatttctgattggagtgagactctaggagacaatggcgtatttgtctggagcaagggcgaccctgatccccactttgcctcctgagcagacatccaacaggtttgcccaaattgctcccggaaggccttccccgcctacttcctgcattccaaacagaggctgtgggaatcctcttggagctctgggactgtccagagcatctgtttgttggcagggtgactgcaggcctggctatcctcatttctggccactctgaaggtttcaggcctgcagcctctctcatccaggctggggcagggcaaggttgtgaggaggccccaaggcttctgctgctgacgccgccacagctccaggcagctaaggggtgactggcttcccagtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctccttgcaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacag

SEQ ID NO: 2777 - DNA, 2143 bp, Homo sapiens
ccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccag

SEQ ID NO: 2778 - DNA, 6067 bp, Homo sapiens
agggggaggggcggccctggtacgcaggcgcgcatgctttgtgggggcgaggctgtggtggcccgagattccaggagggcttcgtgtatggacctcaagcgttggaggtagcagacttttcagcagaagaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 2779 - DNA, 6246 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 2780 - DNA, 5883 bp, Homo sapiens
tctctgacaagaaacattcagcttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 2781 - DNA, 1448 bp, Homo sapiens
agcttttatggttcttacctttaggtggacctcttttaaatagcatggattttgtttttaatccactatggaaatacctgtgtcttttagctggaaaatgtattgttttactcgtcaggcctaagttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagca

SEQ ID NO: 2782 - DNA, 955 bp, Homo sapiens
agcgggtggaggatttgtttgagtacgaagggtgcaaagtgggacgcggcacctacggtcacgtctacaaggcgaggcggaaagatggattccaggagggcttcgtgtatggacctcaagcgttggaggtagcagacttttcagcagaagaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttg

SEQ ID NO: 2783 - DNA, 1378 bp, Homo sapiens
gcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 2784 - DNA, 1587 bp, Homo sapiens
gatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatccc

SEQ ID NO: 2785 - DNA, 1289 bp, Homo sapiens
ggacgcggccgggtggggcggcagcgcccgccgcgagcacctccagttctgccggcttctgcgcgccggggccgcctctccttccgccggtgccgcggcgcctcatggaagccccggagggcggcggaggggggcctgcagcgcggggcccggaggggcagccggcgcccgaagccagggtgcacttccgagtggcgaggttcatcatggaggcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtc

SEQ ID NO: 2786 - DNA, 1476 bp, Homo sapiens
atggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttcttcaccaccatcctccagaacttctccgtggccagccccgtggctcctgaagacatcgatctgacaccccaggagtgtggtgtgggcaaaatacccccaacataccagatctgcttcctgccccgctga

SEQ ID NO: 2787 - DNA, 2654 bp, Homo sapiens
atgagagggcggggcggccactttgctgcaggagatacccaaagccagttagcactgaggaagtcagaagagaattgtcagtctctcggacaccttcattttctgccccggaaatttctcctccgctgttgtctgggctccacttccgacccccagttgctaccagctgtagtccgacctatcgtggcccgggctagtgccagcctcccgccgctacctccgcctcgtcccttctcctctgcgcctgcgcgaccggaaaattcgcgaaggttcctgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattc

SEQ ID NO: 2788 - DNA, 2003 bp, Homo sapiens
tagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 2789 - DNA, 2619 bp, Homo sapiens
gcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaa

SEQ ID NO: 2790 - DNA, 2596 bp, Homo sapiens
cacggcttgcgagctactgaagcgctgccgtctgtacggacgacgctgcggtctttggggcttgctcctacctgccaggcgcggcctcccgctggctccctggccgcgcggcgcctcctccaggccccagcacaccctgccaaccccaccgccgcggctgcccccaccgggaccgaggcaacctcccaaatgtgggcaactcactctgggagaccgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgc

SEQ ID NO: 2791 - DNA, 2253 bp, Homo sapiens
acttccgggctcggcagctagactagcgggggcagcctcagagcgggtgagcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgc

SEQ ID NO: 2792 - DNA, 1962 bp, Homo sapiens
gcttggggacgcacggagaggtgcagctggggtggctcacacctgtaatcccagcacgttgggaagccgaggtggggaatgactctgctctgccacagatcctgatggctgactcagaagcactcccctcccttgctggggacccagtggctgtggaagccttgctccgggccgtgtttggggttgttgtggatgaggccattcagaaaggaaccagtgtctcccagaagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaata

SEQ ID NO: 2793 - DNA, 2659 bp, Homo sapiens
tggtcttgaactcctgacctcaggtcatctacccaccttggcctcccaaagtgctgggattccaggtgtgagccaccacacccggccctattttcattctgtttaaagatagggtcttggtctgtcgcccaggctggagtgcaatggtgcagtcagggcacactgcagcctcaacctcctgggctcaaggaatcctcccatcttagcctcccaagtagttgggactacagatgtgggcaactgtgcctggataattttgtagttttttttttgtttttttgttttttgtagagacagggttttgccatgttgcccaggctggtctcgaattcctaggctcaagctatccattggcctcggcctcctagagtgctaggattacaggattgagccaccatgcctggccggatatgtaaattttaatagattctgtgaaaatgaattgtaaaagtttgtaacaactcccatgtttactcagaaccatgtgtgaatgttccctattcctacaactttggcaatgtttagtagacggggtttcaccgtgttagccaggatggtctcgatctcctgacctcgtgatccgcccgcctcggcctcccaaagtgctgggattacaggcgtgacccactgcgcctggcctgtatgacccgttttacatgaaatggccagactagacaaatctacagaaacaaagtagattagtagttgccaggggtcggggaaggggagaatgggaaatgactgctactgaggtttttttttgggtgatgaaaatgttctggcgttagatagtgatgatggttgcaacaactttgtgaatttatgaaaaaaacacttaattgtacacttttcaccccacttcctctgccatcttggtcctgctgtcctgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatctctgccctgtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttcc

SEQ ID NO: 2794 - DNA, 2122 bp, Homo sapiens
ccacggcttgcgagctactgaagcgctgccgtctgtacggacgacgctgcggtctttggggcttgctcctacctgccaggcgcggcctcccgctggctccctggccgcgcggcgcctcctccaggccccagcacaccctgccaaccccaccgccgcggctgcccccaccgggaccgagggtggctcacacctgtaatcccagcacgttgggaagccgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaa

SEQ ID NO: 2795 - DNA, 1178 bp, Homo sapiens
gcactttacagaggcggcaagactagggtggaggaaagctcaagggccatcgctgggtgcttcggtggcgggcagaaacgggactggcagtgcccacacgtgtgcgttctccccgtccgcccgaaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtttgtgagaaggaggaggacctttctttgccctttttatgagttcctcctcccccaccgttctcttgctctagtgtctggcagggagggatgattcctctttgattcctctccagctggacccaggccaggccagggaggcggctgcctggtcccttcatgctcatgtttgtcaccattccctggggtcagtggtctagttcctgctatctccggacgggggctgtctcttgggggcagccccagatgtggagaggtgtggtcaagaggatctgctgatcctggatccattctgggatggtatgatcctgagaattgtggcctgggagccagtcatacctgcttctttgatgagctcttctggtagaaagggaagggaggcaagctccagtcttgacccactgctccttcctcttgccaccgccccctccctgtgacaggtggctccatctccaacatgtatgctgtaaatctggcccgctatcagcgctacccggattgcaagcagaggggcctccgcacactgccgcccctggccctattcacatcgaa

SEQ ID NO: 2796 - DNA, 2155 bp, Homo sapiens
gcttggggacgcacggagaggtgcagctgggtgagtgggcggcgccgtgcgccgagggcatggaggaggctgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccatgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaa

SEQ ID NO: 2797 - DNA, 700 bp, Homo sapiens
gcccattccagttggagaacgtagtgagtctttcagtggagccagggtctggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcgaattgcactttgatgttcagaaacccactttgttctcagccacgcaaaactccctgaccccgatgtgatttttctccccggggattcgagagccatgcgtgggacactggaccctactgtctacacgggcttgcacacagcaggtgctcagcaaatgtctattgatttgattgtcttttgaagatgtcataataaagcttctacctcctgagaaca

SEQ ID NO: 2798 - DNA, 1875 bp, Homo sapiens
gcagcctagtccgcggcgcgggagggcaggtgggagactggaggcgccctcgcgcccctcagctatccgggagcctcgcgccggcgacctcgaccctgtcgaacccggcggaacactcagaaagaagctgagcgcctcgcagcggccaggacagcgggccaggcccgcgcgctcccgcagcgcacggccagacgcgacgcccctcagcacggaacccagcctcgcggactaccccgaagctcagagccacatcccgcgcagaggaccgcggcgaccggaaaagcaaggcagaggcggaaaaccaccgcgaggtcccgcctcccgctccgcgcctgcgtctgcggctgcaccggggttggccgggccgcggtggggcggggccgctcaggcgccttggacgcggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 2799 - DNA, 3383 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggt

SEQ ID NO: 2800 - DNA, 1898 bp, Homo sapiens
gctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaaga

SEQ ID NO: 2801 - DNA, 589 bp, Homo sapiens
atctggctgcgcctagtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatggattactggaagcagctaagatgcctagatga

SEQ ID NO: 2802 - DNA, 2428 bp, Homo sapiens
gtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgtgattttgcaattctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactga

SEQ ID NO: 2803 - DNA, 2648 bp, Homo sapiens
gtctacaccagcggtgtcgctgcccgaaagtgagagaaggctgatactgctagctggaatccaggcctgggtgctgcatggtggcgcccctccccgtgaccaccgctgcgttttctcgggctttctctggggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgtgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcagtgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaa

SEQ ID NO: 2804 - DNA, 921 bp, Homo sapiens
tggtagggggagaaggaagatacagagtgctttcaaaagtgcctaaatcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacgg

SEQ ID NO: 2805 - DNA, 1475 bp, Homo sapiens
tcatatcagcaggctgagtgttcatgtcaccagaagtctgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctggggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggcagaggagactctaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatag

SEQ ID NO: 2806 - DNA, 1972 bp, Homo sapiens
ctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgtgattttgcaattctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctg

SEQ ID NO: 2807 - DNA, 999 bp, Homo sapiens
aggctgagtgttcatgtcaccagaagtctgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctggggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaa

SEQ ID NO: 2808 - DNA, 3744 bp, Homo sapiens
ctttcatactgcctcctcccttgtttttctgtctcagagagatagtctgtcctaaatatcccatgtagcccaggccactgaattaaaacggagcgtattcgttctctgccccaccccgcaactcctgaaagcggcgcaactcaattacttgatccttatatgccccacgcgggactcatactacgtttcccgtgaacacgtgcagtccaaaccccgcccctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcattttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactcc

SEQ ID NO: 2809 - DNA, 611 bp, Homo sapiens
aaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggagattcatgaggaatta

SEQ ID NO: 2810 - DNA, 985 bp, Homo sapiens
catagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgagg

SEQ ID NO: 2811 - DNA, 3143 bp, Homo sapiens
cgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagatgaagaaactgaagctcaaaaagatgacatcatttgtctcaaggcctcttgggtaatatgatccaaatggaaggacaaaagttcagtgtcagttctgtttaacaatgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtcacatttaataaataattgtgacacatagctggggggtggtgctggaggtttcagaccgcctcacaggcagagttccagggtcagagagcatggagtactgtgtgtgaccttcttccagaagcacgggcacaggagcatgttaaaggccctgaaaagaccagtggcaaagaaactcctttcattttgtttaatccagagtttttcaagcttatttaactatagaacacttttctgtgggtttcgtagcctctttctagcacagtatagtgagtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatcctattgactcagctccaaatagcgggggcctgtcaggagcctgactctgttcagacaccagggaaacaacagcacaccaggcagatgcagttatgtccatcggggaacttacagcctagcaaggaaggcagcaattcaacctgtaagtctaaaagtgatgggtgtcatgaaaaggtaagtgcagggtgctgggagagtggttggcaggggctttagcctagtctagggagagcccaggggcacaccactgccagcggggatagaggcttcaaaagctttgaagtcactcatattaagagtgttgccggacacggtggctcatgcctgtaatcccagcactttgggaggctgcggcaggcagattgcctgagcccagaagttcgaggccagcctggccaacatgacaaaaccctgtctct

SEQ ID NO: 2812 - DNA, 3434 bp, Homo sapiens
tagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtcacatttaataaataattgtgacacatagctggggggtggtgctggaggtttcagaccgcctcacaggcagagttccagggtcagagagcatggagtactgtgtgtgaccttcttccagaagcacgggcacaggagcatgttaaaggccctgaaaagaccagtggcaaagaaactcctttcattttgtttaatccagagtttttcaagcttatttaactatagaacacttttctgtgggtttcgtagcctctttctagcacagtatagtgagtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatcctattgactcagctccaaatagcgggggcctgtcaggagcctgactctgttcagacaccagggaaacaacagcacaccaggcagatgcagttatgtccatcggggaacttacagcctagcaaggaaggcagcaattcaacctgtaagtctaaaagtgatgggtgtcatgaaaaggtaagtgcagggtgctgggagagtggttggcaggggctttagcctagtctagggagagcccaggggcacaccactgccagcggggatagaggcttcaaaagctttgaagtcactcatattaagagtgttgccggacacggtggctcatgcctgtaatcccagcactttgggaggctgcggcaggcagattgcctgagcccagaagttcgaggccagcctggccaacatgacaaaaccctgtctct

SEQ ID NO: 2813 - DNA, 679 bp, Homo sapiens
gactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcaggtagcgggaggaccaaagcttcacagccctgctttgctatttgctagctgctggccttgaccaactagcgtactctcccttaagcctccatttgtcatcttcaagatagacatagtgacacatgactcagagagttcttgggattgaactagataatgcattttcataataaataataacacaatca

SEQ ID NO: 2814 - DNA, 1148 bp, Homo sapiens
atgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctccta

SEQ ID NO: 2815 - DNA, 1003 bp, Homo sapiens
ggaaaatcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctag

SEQ ID NO: 2816 - DNA, 1207 bp, Homo sapiens
ggaaaatcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctag

SEQ ID NO: 2817 - DNA, 1156 bp, Homo sapiens
gaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtaaggagcttctcaattcctttgatttgtcaattcctgtgtgaaggtttgtttttccaacctgtgaaagaaacgtgaatgtaaaagagacctaaataaaaggataattatatttattctctagttgatcagctataaatttatataaaacataggcatgtttgtactaatgaaacgtactgtcaacctctatcacattgttaaattaacacttttggtggtaactcaataaaattgagaaaattgg

SEQ ID NO: 2818 - DNA, 807 bp, Homo sapiens
gggctgcttctggtggccttgctggccagcctgactgtgatggtcttgatgtcagtctggcagcagaggaagagcagggggaagctgcctttgggacccaccccattgctctttattggaaactacctgcagctgaacacagagcacatatgtgactccatcatgaagatcagtgagcgctatggccccgtgttcaccattcacctggggccccggcgggtcgtggtgctgtgcggacatgatgccgtcaaggaggctctggtggaccaggctgaggagttcagcgggcgaggcgagcaggccaccttcgactggctcttcaaaggctatggagtgacctgccgcacctgggagcgcaccaagccgctcaggcgcttctccatcgccaccctgcgggacttcggggtgggcaagcgcggcatcaaggagatccaggagaaggcgggcttcctcatcaaggcccatcagagctctgactccagcatctatcccaccttcttcctaagccgtaccacctccaatgtcatcagctccattgtctttggggaccgctttgactatgaggacaaattcctgtcactgctgtgcatgatgctggaaagcttccagttcacggcaccctccacggggcagctctatgagatgttctcttcggtgatgaaacacctgccaggaccacagcaacaggcctttaaggagctgcaagggctggaggacttcattgccaagaaagtggagcacaaccagtgcacgctggatcccaattccccacgggacttcattgactcgtttctcatccgcatgcaa

SEQ ID NO: 2819 - DNA, 1413 bp, Homo sapiens
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 2820 - DNA, 1407 bp, Homo sapiens
caagaggccctgaccctccctctgcagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgggagcaatgggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagacgcccctttcgccccaacggtctcttggacaaagccgaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 2821 - DNA, 1566 bp, Homo sapiens
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgggagcaatgggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 2822 - DNA, 1680 bp, Homo sapiens
ggaagggtcacgcgctcggtgtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 2823 - DNA, 1240 bp, Homo sapiens
cagttgcggcgccgcttcggggacgtgttcagcctgcagctggcctggacgccggtggtcgtgcaatgggctggcggccgtgcgcgaggcgatggtgacccgcggcgaggacacggccgaccgcccgcctgcgcccatctaccaggcgaccccttacccgcatctcccacccccaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 2824 - DNA, 2511 bp, Homo sapiens
ttcccagtgaagaaaagacagagctgccacttgtacccagattgtctggatcctaaaatcaatagcctaaaaagataataatttgcctcttacaccccaccaagaaattctgttcaattctgttgagctgagagggaagaacagggagactggaaatatgaagaaaggggaatggccccagaggatttccctgtgtgaattcaatttacctttattcaggtgggagattataggttatataaccacccccaatataaagcaatctcttccccgatgacactcaaacccggaaaacttgaatcccagggtgttcagattttggtataagctgatctcccaggacctacttaggcaggatctggtgcccaggacagaacctgttgacctggcaccatggagctgggaggggctgtcaccatctttctggcactccgcttgtcttgcctgctcatcctcattgcctggaaacgaatggataaggcaggaaagctgcccccaggtcctacaccaattcttttcctggggcacctgctgcaagttcgaactgatgctacgtttcagtctttcatgaaggtgagtctgtctgtctcctttaatagggctaaaagcaactaatcctatagccagattcacatagaaacttatgacttctaaaagatagactctcagaaacacagactttgcaaatcttagaattctgaaattccagaatcctaaaatgttggaaacacacattctcagtgcattgaaataagattttcatgatctcaggactttggaatcacagtacattatatttttaaacacaggattctttgactcagcttgtcttagcactttgagacttggtatcatgaagtcttaagattctagaaatttaacatttcagagagagaagtatgaatcttggaatttatcgaatccaggtcccttattttggagatgcagacagtaactcttgtgggaagggatgagcttttgccgagaatgacagaagccaagacttccgtgcctctttcccagtattccttccaagcccagatttaccttggttccttagtaccatgtttatatccctctaaaatcgccatcctctaaaatcctcaactggcctatgcttggtactccagtcagcccctcctcttgtgttttccttcactccaagctcagggagaaatacagccctgtgttcactgtgtacatgggtcccggccagtggtggttttatgtggacacgaagcagtgaaggaagccttgatagaccaagcggatgagttcagtggccgtggagaactggcttcaataaagcaaaacttccaaggtcatggatcctgcagagagggaaccttactctcttgattgagtcttgaaggttgaggatggcttcctggacagcagagtctagagctttcataatctttccccatcactgcctaagcacagagttgaacacagcaaggggagggaggcagaagcctgagactgagatcttggcaggtgtagctctggccaatggagaacgatggaggattctccgacgcttctccctgaccatccttcgggacttcgggatgggaaagcagagcattaaggagcgaattcaggaggaggccagctacctactggaggagttccagaagaccaagctaagattcacgaagagattaaccaggtgattggaccacaccggctcccaagggtggatgaccgggtcaagatgccctacacagatgtcgttatccatgaaatacagagactggtagacatcgtgcccatgggtgtcccccacaacatcatccaggacactcagtttcgaggttaccttctgcccaagggcacagacgtatttcccctgcttggctctgtcctcaaagaccccaaatacttccgctacccagatgccttctatccccagcactttctggatgagcagggccgcttcaagaagaatgaagcctttgtgcctttttcctctggaaagcgcatctgcttgggcgaggccatggcccgcatggaactctttctctacttcacctccacccttcagaacttctctctatgctcgctggtgccacttgtggacatcgatatcacccccaagctctcaggctttggcaacatcaccccgacctatgagctctgccttgtggcccgctgagccacacctcctgcggggcaaggaggaagtggtgaagaatgcagctctcctctcgtgttcaggagcaccccctcttcctcatcttactaatcctcaagcatccctaagaggaggcactatgattacagagtcagccagggtcacctgagaatgtacagctgcgtgtcttcctctcccgtagaagagcaacgccctgtgcaagatttgcacctctgcctgcaggtttcatggtcacatggtcaccgttgcttaggtttctggctgcatcaaattattactgcagtccctgtgtcttcatgttgtccctttttgtgtgtgctctgattttgaccaaaatgtagtctaaaatcctt

SEQ ID NO: 2825 - DNA, 4401 bp, Homo sapiens
agtctccttgtgcgatctcccagacatgagagccctgctgggctttctggctcctcctccgtgcagagttgtcccgtcaggagccaggaggggcgacgctggctccgtgggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggagggtgagcgggggacttctcacatacctcttccttagccaggctctgacgctgcaggagatctacgccaacgtgactgagatgctgctggccggcgtcgacacgacgtccttcaccttgtcttggactgtgtacctcctggcaaggcacccagaagtgcagcagacggtgtaccgggagattgtgaagaatttaggggaaaggcatgttccaactgcagctgatgtccccaaggtcccgctggtcagagctctccttaaggaaaccctgaggctgtttccagtgctgccagggaacggccgggtcacccaggaagacctggttattggcgggtatctgattccgaaaggcacccagctggccctttgccactatgccacatcgtaccaggatgagaacttccctcgggccaaggagttccggcctgagcgctggctgcggaaaggagacttagatagagttgacaattttggatccatcccctttggtcatggggttcgcagctgcatagggcggagaattgcagaactggagattcacctcgtcgtgatccagttgcttcaacattttgagatcaaaacatcttctcagaccaatgctgttcatgcaaaaacccacgggctcctgacgccaggggggcccatccacgtgcgatttgttaacagaaagtaagcctagattttaaacctgggctgatgtagcagaccagctcgccgacacacagtgggtatttgtgttcgctgatcaccgtggagaaggaaagcgatgtcgctaaaggctgtcttgttatagactggcctcccaggtcctgggacacttgtaaatctttatgcaaagtaatgtaaaaaggttgctattttactggtgcataccagaagttgccctttctttgggggaaacagctgtttaaaaaccagtggcagtgaatttttatgcttcatacattgtgctagactcaatatttaatgactggcagtatcctgtgcatttacttgtacagggaaatggtggtttacttacaaattcagttcttcaatatatgttctctaatactggcatctgggctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgcacacctatggtcctagttactcggaagactgaggcaggaggatcgtttgagctcaggaggttgggtctgcagtgagctatctatgatggcaccactgcacttcagcctgggtgacagagtgagaccctttctcaaaaataaaataaaataaaataaaataaaataaaataaaataaaatggctgtataagaatacttttctctccacaacgagtgcttaattttctagtcataatgcctaatgaagttgactattagtttttatttggaagaaataaataataaataaataataaataaataaaaaagaaagctcctggtgaaatcaagaataatcagattttctaaccaaatctaaatacagagtagagcagacgtataagaactggaaatatgatgacgtaaaattttgttgcctaagttgtgagaagtaataaaacaggcagcatggaaaacaatgtaactttagaacatttttatttcaagggaaaataaatacataaatagagatgctacagatacaacaatatttttatcttgatggtgttgttttaaatatccacacaagaaccctcacccagttgtgtgcctgtgccaggctctctgggaagccgtggctccgggagtgctgggtcctgaggagttctgttgcctttcctgctgctcaccggttgctaagaggaaacaccgtgatttcctgatgctcttgccttgtcatcatgcctgaaacagcttattcccaattctgtaattccttttacataatccttctccaaaaattactttcttactaatatagaccatacagttttttttccatttagtaagtcactctgcaaaataacccttaagtaaatagacataatatccatttcacataccatttttgttaaagtatataataaagttgaaatctctgtgtggtagcagaataactctagtatgaatgctgtaaatgtacaggtaaatgtgaaattaggtcatattaactggccaagtgttggattgattactttgaggtagcagtatacgtatattaagttttataaactagatgaaattgcattctgtttgagactgaaatttaaaaatattgagaataactaagcgacttgaagtgacctcttattccctgggtatacatacagtgtgaccctctcgtgaagtgtggctctgcctggggatcagcacagggtgaatagcaaagtgcgggctgggggtagcacctgtgcccgctgctgagtctcactgaacaggaagggaagcagccagacacgggggcctcctggtgtgatgtagcaggaagtgcagggcgccacccaggaagcatccacgccaaagaaatggagattcagctggacaagtttctaggttcgctactggtttataggaaatatgtggtatacagggagatgtcaaaactccatgggggctgggcgtggtggctcacacctgtaatttcagcactctggggaggttgaggcaggaggattgcttgaggccaggagtttgagacaagcttgggcaacacagtgagatcctgtctactaaaaatcaaaaaacttagctgagtgtggtggtgcatgcctgtagtcctagctatttgggaggctgaggctggaggattgcttaagtctgggaggttgaggctgcagtgagctgtgatccgccattacactccagcctgggtgacagagcaagacttcataacaaacaaacacacaaacaaactccatggggatgcagtcagcaaaatccagaatagagtgaggtctataggaccaatgtctcgggtttccaacaaaacaaatacgtgacaggcaaaaaacaagaggaggggccaggcgaggtggctcatgcctgtaatcccagcactttgggaggccaaggcgggcggataacctgaggtcaggggttccagaccagcctggccaacatggtgaaaccccatctctactaaaaatacagaaattatccaggcatggtggcgggcttctgtaattccagctacttgggaggctgaggcaggagaattgcttgaacctgggaggcagtttgcagtgagctgagatcacgccactgcactccacctgggcaacaagaacgaaactccgtatctaaaaaaaacaaaaaccaaaaagcaaaaaaaaaaccaaggggagaggagaactgttacagatgaagcaatataggagacatattaaccaagtacaatgctggacttcgtttgaatcagattcaaataaaccacttgtaaaaagacatttaagagataatttttaaaaataaaataaaagccaaaaatattaattcttccaatgcatgaaaaaaagagagcaactcggggaaatttgaatgctgactgtgtgtatttgatgatatttgggaattactgttaatttttttgttgtgataatggtagttatgttt

SEQ ID NO: 2826 - DNA, 2092 bp, Homo sapiens
agcctcgccgccatgccggggccgaggaccctcgccaacctggcggagttcttctgcagggacggcttcagccgcatccacgagatccagggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggagggtgagcgggggacttctcacatacctcttccttagccaggctctgacgctgcaggagatctacgccaacgtgactgagatgctgctggccggcgtcgacacgacgtccttcaccttgtcttggactgtgtacctcctggcaaggcacccagaagtgcagcagacggtgtaccgggagattgtgaagaatttaggggaaaggcatgttccaactgcagctgatgtccccaaggtcccgctggtcagagctctccttaaggaaaccctgaggctgtttccagtgctgccagggaacggccgggtcacccaggaagacctggttattggcgggtatctgattccgaaaggcacccagctggccctttgccactatgccacatcgtaccaggatgagaacttccctcgggccaaggagttccggcctgagcgctggctgcggaaaggagacttagatagagttgacaattttggatccatcccctttggtcatggggttcgcagctgcatagggcggagaattgcagaactggagattcacctcgtcgtgatccagttgcttcaacattttgagatcaaaacatcttctcagaccaatgctgttcatgcaaaaacccacgggctcctgacgccaggggggcccatccacgtgcgatttgttaacagaaagtaagcctagattttaaacctgggctgatgtagcagaccagctcgccgacacacagtgggtatttgtgttcgctgatcaccgtggagaaggaaagcgatgtcgctaaaggctgtcttgttatagactggcctcccaggtcctgggacacttgtaaatctttatgcaaagtaatgtaaaaaggttgctattttactggtgcataccagaagttgccctttctttgggggaaacagctgtttaaaaaccagtggcagtgaatttttatgcttcatacattgtgctagactcaatatttaatgactggcagtatcctgtgcatttacttgtacagggaaatggtggtttacttacaaattcagttcttcaatatatgttctctaatactggcatctgggctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgcacacctatggtcctagttactcggaagactgaggcaggaggatcgtttgagctcaggaggttgggtctgcagtgagctatctatgatggcaccactgcacttcagcctgggtgacagagtgagaccctttctcaaaaat

SEQ ID NO: 2827 - DNA, 2249 bp, Homo sapiens
gtccctgtaagcatcacattgctggaggaaaatctcatgccagagcttggaccatcccctagctcaggggttaggggttgtcccttggtgacctaaatgaaaaaacaggtccagaacagagttcctgatgctggacactcattcagtctttgaatcgtgggaggggaggcctggtactaggtagacctaacctctttgaggaaccacagagcccaaggctggaaacctccagaatcctccacccccttatcctccctggggacccctgtggcctgtctcactgagcactcttccatctgtagatgtctgggctgctgtacaagggagtcccctttcaggtgtggtgctagacatggtcactcctgctggatgtctaggtggtagaaaccaaggacctagggaaataccaggtacagcctttccacgctcatccagagcaggacaaacaggccaggcggtgtcaggagcccaggtctccagctggagggaacgtcaaccctgcagtgggagcaggggccctttgcacatcctaggcacagatggtaatgtagacaccacaggtaagctgggcttggtacctacccctccccggattcagaaagaaaccaaacaaggagctttgtgtggaatgaaacctcctttcctcccagaagcactgctgattgtttggtggttgccatttgtggcagtgagcccttgtttgttctgaggttgggctggtttctcctcttggccctgccctacagatcataaaggagaacagcaagacgtccccagcaaacatccacagatggccttggaaataagtcaccttcctcaccctgcaggaatgccagtgaacatattgctgacatcttggagctcagtaccctcatagtgtaacggcgtcagtagatctgcctgtgctgggacttcctgtactacccattcctgaggggcgatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccgggatcttaattcaggaggtagaatggagcttgagatcaagtgtctgatcaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatggatcatgaggatcagagaggaaaagtcacttgcccaaagtcacacagctgaacagtggtggagttcaactttgaccgtgggctgtctggccccaaggtgtatgcttgcttctctcccaagagactcctttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggtgcaggggtgagaggcagggaaatggagacccccacagccagcatcagtggccctcatcacagccctccaggagatatcaaaggaggtcagaccttggacagtagtcttgacttcctgctatagaacacattgttaacactgaaaaagatgatctgttctaggggaatggtgaaagctgactctagcacttgtgctttttgtttgtttgtttgagattgagtcttgctcttgtttcccaggctgcagtgcaatgcgtgatctcagctcactgcaggctctgcctcctgggttccagctattgtcctgcctcagcctcccgagtagctgggattccaggtgcccgcaagtgtgcctggctaatttttatgtttttagtagagatgggatttcgccatcttggccaggctgttctccacctcctgaccttggccaaagtgttgggattacaggcataagccattgtgccggacctgtgtttttaatttcatcatggcacagcttcaaaatgacatctaagtagctgacataaaaatgaaaattctgtgtactttgatattagcaggcttcaaatacaaaccagaatatgagt

SEQ ID NO: 2828 - DNA, 3286 bp, Homo sapiens
cggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 2829 - DNA, 633 bp, Homo sapiens
agtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcagggttgtgaagactaaatgggaaagtgtttaaaactggtccacagtgagtgcttagtaagtcttgatgctgcttgaaaactcagattccgagaaggagcatctga

SEQ ID NO: 2830 - DNA, 5599 bp, Homo sapiens
ggctgcatttcacaggaaaccaagtctaaaacggacctatcaggaggttttctgctgaagggcactgcttagcatcgagaagaattcaacccaccgccttactaatttccagtgccccaaggtctctgcactgccgcccctcctcacaggagacggacacctcagcctagatcccttggtgctctccacgctgttcaggctgaattgaagatccctcttacccgccaggtgccaagaactatgaacaggcagggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaataaaaataaaaactagggttttaaaagtatcttctaaaaaacaacaacaaaaaatactataaacatagccattatgctcatgatacaggcgagcagcaaagggcaccagaagctgttgcttaaatgtttgcagtcagtgcaagacaagtctatgggaaattcccaaatctgtgctctttacaggacactgcgctgcctttatgtcagttgttgggccttacatatatacaatgtgtggatgatttcttacactaaagatgctgggctgggtgcggtgcctcatgcctgtaatcccagcactttgggaggctgaggtggacagatcacgaggtcaggagatcaagaccatcctggctaacatggtgaaaccccatgtctactaaaaatacaaaaaatcagctgggcgtggtggtgggtgcctgtagtcccagctactcgggaggctgaggcaggagaatggtgtgaacccgggaggcggagcttgcagtgagccgaaatcgcgccactgcactccaatccagcctggggacagagagactccgtctcaaaaaaaaaaaaaggtgttgggttggtgaatattagctctcttttattgtaatcctagaaattcaagtatagggaagaaatgtggtatggaaaaccagcaattgtgaatgtcaccttgaagacagaaactgaaaatcctctgactagggtgtgaaacggtcatgggaccagcctccagcatcatctgcttcaagtagctttaagtcaaatggaattaacacattcatagtacagagctcagattatatcctacactagccttcaggcaagcatatgtctgagggaaactaaaaattgtattaacaattccaattatggacttccattcaaagacagagaaaaactgtcctcaaattagtgctaattcttgcagtaacgttgcacaggccatgatattattccctgtagaggttaagaggatttaattttattattgttttacaataaagatgaggaaacagaggctcgaagtagctattgatcttactcaatatgagaagagagcccagattgtaatctgctttgcctggctccatgcaagctcatcttcccaggtacattctctgcgctgtgacattttacaatcaagttgaaaagctaatttaaaaaaaaagagagagagagagagaaagatagaaacaatttgaaaatacagatttaccaccttaaaataaataaactcttctagtgggaataagcttttttaaaaaacatactgtctgtcgaaaataacagtatatcatgatgtcaaatgctaccaaagcttacaaaggaaattcatagagtatttatgtaattgtagcattgatgcagaaagaaaaccaaaaataattaaaaggcaatagaagcaaatgaaaacaataaaaacaatgtgcaggattatctcttttgtaagacagcagacaatgagctctctgggaaaagctcttagcatctacccactatccaaatacctgctcaggtgttctcctttcacaaggtcaatgtgaagtgatgcctataagttacatcaggagcatttaatgaagaagctatttgtaaagctggaacttttgagacccagctgagcctatcgtagagtatgcctgcagaggattacatagaaccaagagacaagagtgtttaaattggagcttggatacgaaagaactcactggtccggtcaaagctaaaagctgtatggttgctggtcattctctactggaattcaacaagccagggacagtatggaaacaaggactttacagaagagctccaggctcacattaagaaggaatctgaccctcaccctaaaaagctattgggagattactgatacctccaactcactgattcattgaggccatgccattcaatgctatgttctcaagaaatgtctatgagtcctctcaaccattgctgttgataaaataggtgaatgtcaagtgggggttagcatttgataaggtgtacgtttgaaataatattttatcgtctcttgttcacaaatacaacatataattccaagaagaaaaaagaagtagaaattcagcatccttaagatgacagcaagaatgaggggaaaaggaagaaaaaaaagaaattaaacatcttgcaataaaaagcttacaatatttttgtgtatttgaacacttctgtaaaaaatataaaatggaaaatactgacatgggctgcttctggtgattggggtttgagggattgggtgtcgggttttctagaactcagacaccaggacaaagttagaagtgcaaacactgattggaggttaatgtttgagaaagataaaagggagaagaaacagaagtatgggtatggggtgggctttcaggctcccacctgtgagagggaagaggggaggtgtggggagtgaggagaaaaagcatgagattcagacacagctctgggagagttttggccagctcatagtgaggcccaaagcaaagtttgcccagagaggagacagtgttatgctgggcagtaatgtctgggtcttagtgccccatcctgttaagtcattgtctggggctatcctgggaaaaagaaaaacaacaaaaaaaaaagacctgcaaatgctgtggccaatccagaaggcgcagctggacgctgtccactaacttgctggccagcaagttatttcaatggagactcaagagacccacctctggcctgccacagcaacatcctgaattcactgttttcagtgttgattgtagtaaggacaatcacatttacattttgcttgtaatggatgattaaataataagagtatataaattcgattgtatttgtttcttacaacacttctgtaaagaagagagggcagctatttctaatgcattttataattgaggaaattgtacctcattggccaaaatctcacagtgacatagtcgcgactggaaccaaggtctccatatgcaattatcctattcatggtctacctgctttattagatctgtaattgaatattcaatgatttggatttggcatgcccaaattccagtgttttaatcccttttcaaccattacctcacgtttagtttaaaagtatcacttgatatctgatttcaatagagtaatagaattttagctttatccaattacagcatttatgctttccagatattttttggactaaataattctcattctgtataaatgtgcatagccctcatcattagtcatatattgtgttagcacctttgtgtactgcatgtgtattcattactaagcactattgtagatgttgaaaatagagcagtgaataagagagatagatgacaaataaatatacaaacaaataagataatctaagtcagtttcccattactggattggatttctattttaacacttatttctgagtacttgtggggtgatgccaacattaaatgttttgaggaagctcctttgagatggctttgaaaagtcctaagtgagaaaatttaaaattttcccaaacttatttatgtggggtgtgcatgtgtgtgcctgtgcctgtgtgcgtgtgtgtgtgtgtgtttttaagtaaccgcatcatggctgtaatcagttaagtctcctgttctaattactacggaggaatcaaatgaaccccattgtcgaatgtagccaattatgtatgtgtgtacacaaatacaaatttttatgatagcctatattgtatattagcattatatttgtatatcttttttattctgagcaatatttgttctagctaagcacatttacattcataatttacagccttactaatgtaaataaaagtaaatatgtaattgaatgtta

SEQ ID NO: 2831 - DNA, 1944 bp, Homo sapiens
atgaatcccaggggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacatcaggccacctttatctcagagacacacctttccagaagtccagagaatgcccagtcagataagcttaagggacttaagtgagtccttggaagcaaagaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaataaaaataaaaactagggttttaaaagtatcttctaaaaaacaacaacaaaaaatactataaacatagccattatgctcatgatacaggcgagcagcaaagggcaccagaagctgttgcttaaatgtttgcagtcagtgcaagacaagtctatgggaaattcccaaatctgtgctctttacaggacactgcgctgcctttatgtcagttgttgggccttacatatatacaatgtgtggatgatttcttacactaaagatgctgggctgggtgcggtgcctcatgcctgtaatcccagcactttgggaggctgaggtggacagatcacgaggtcaggagatcaagaccatcctggctaacatggtgaaaccccatgtctactaaaaatacaaaaaatcagctgggcgtggtggtgggtgcctgtagtcccagctactcgggaggctgaggcaggagaatggtgtgaacccgggaggcggagcttgcagtgagccgaaatcgcgccactgcactccaatccagcctggg

SEQ ID NO: 2832 - DNA, 773 bp, Homo sapiens
aatttccagtgccccaaggtctctgcactgccgcccctcctcacaggagacggacacctcagcctagatcccttggtgctctccacgctgttcaggctgaattgaagatccctcttacccgccaggtgccaagaactatgaacaggcagggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccttga

SEQ ID NO: 2833 - DNA, 1143 bp, Homo sapiens
gacaaagtcatgccagtccttccatactggcagttttaatttttacgaaaccacattcttcacgatgcctgatgctgtgcagaagagcgtagtctagaagaaagaacacggattttggagacaggcattcctctcaaccccaaacctgccatctcctagccatgtaactttggacaaggggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccataaaatagggatgggggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacggtgagccaagatcatgccattgtactccagcttgggcaacaagagcgaagctccatctcaaaataaataaattaattaaataaataaaaataaaataaaa

SEQ ID NO: 2834 - DNA, 2009 bp, Homo sapiens
attttcccttctaggctatgcctgagtgcctgtggacacagggtgtactgcaggaagttctgaacagctatttctgtggcagcattattctctcgaccctgccatgggaggtcccaggtgggcatgcttcccgtatctgcttgcttctccttgcaacaggggagaacaagcaggtggagtgctaccagctgagtccaggtttgagcagcctgcctgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgggg

SEQ ID NO: 2835 - DNA, 3089 bp, Homo sapiens
agccggctgatgtcactggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 2836 - DNA, 1559 bp, Homo sapiens
ctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctg

SEQ ID NO: 2837 - DNA, 3074 bp, Homo sapiens
atgtcaatgccactcgaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 2838 - DNA, 3175 bp, Homo sapiens
agccggctgatgtcactggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 2839 - DNA, 3181 bp, Homo sapiens
cggggctgcgcgcggcccgctgcaaaaatagtgcccacgtgcgtgcgcgtctctcgcccgccggctggccggtcagcccgtcagccccgcagggccacaccggccccatggcgttcccgctggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 2840 - DNA, 2112 bp, Homo sapiens
cggggctgcgcgcggcccgctgcaaaaatagtgcccacgtgcgtgcgcgtctctcgcccgccggctggccggtcagcccgtcagccccgcagggccacaccggccccatggcgttcccgctggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaa

SEQ ID NO: 2841 - DNA, 1681 bp, Homo sapiens
ccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttac

SEQ ID NO: 2842 - DNA, 1706 bp, Homo sapiens
atggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaa

SEQ ID NO: 2843 - DNA, 2450 bp, Homo sapiens
aggcaacgactgtcctggggaagacagggcagcgaagattccagtgcaggtctcattcaggaaaggatacatgtgagctggagtggcaaaataaattttaacagagctgaagcttaagttgggcttggtggggagggacgcatgataaactaaggtgtggggagccgatttcaggcagtgcgacaaatttgcagaaatctaagcccctcgtggaaggttgccaaggtgaggtgaccttgagtgaatgcgtgtaggtggaaaaaggttccggggaatgcttgcatcgttctgcatccgagcgtccaacagagaaaagatcctgtttccagacaatacctgcatttggtttttctccagctgagggacaccggtagggggggggaggacagaaacgagcagggggtggggccaaggcgagtgggcgggaccgcgcggaccctcccgcggccgactggaggcccggagcaggggcggagtttccggcggcagcgccactcgggcgtcgggtgacgctaggcggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattaca

SEQ ID NO: 2844 - DNA, 1117 bp, Homo sapiens
gacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctgtaaaagaagatcaagatcacgaccgagagcagggtgaggaagacaacggtgataacaacttggaaaggagagggaaaatgtagagatgtttcaggattgaggatgtctcagtagttcctggagtcatctgatttagtcactgttttcgtaaagatcctcttgttttcattaactagtgtccacttccatccaaacccatgttcccccaccaaccccaatttccatggcacataatagctggagtctcctggtgcttaagctaaggacacatgcttttgatttctgacaaaactgaactgcctcccaaaccagttcctgattcttaaagaaacgggaaggagggaacaggaaatggcttatcctaacaggaagtggtttatctgatcctccccctcttcctcacccactcaaccaaccacatatatcctcgtccctacccacgtactcaagtgtaacgtccgtatgcatatctatttgcggccacctcccaacctgtcatttactggtagtgcctctgacagaagcctccgagtcttttatggctgtgtgtgtgtgtgtgtgtgtgtgtgtgtgtgtgtaatataacttacaagccagagtgagcccattaatggatttggtcaggctccctctggagagagatgcccttgatccag

SEQ ID NO: 2845 - DNA, 701 bp, Homo sapiens
gacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaag

SEQ ID NO: 2846 - DNA, 1810 bp, Homo sapiens
ataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattac

SEQ ID NO: 2847 - DNA, 872 bp, Homo sapiens
gtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctgcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaag

SEQ ID NO: 2848 - DNA, 601 bp, Homo sapiens
ggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaac

SEQ ID NO: 2849 - DNA, 3493 bp, Homo sapiens
caagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcagtcaaaagccagcagagcacactggtcaccagagaggcccagccaaagaccaggaccctgcaggtggccttgccatccacaccggcagagccacccccaccaactcgtcagagccatggcagccatggctccagcctgacccaggtgtccgcccccgctccacgccccggactgcatggaccctccagcacccctccttcctcggggcccgggatgagcacgcccccgttcagttctgaagaggactcagagggagaccgtgtgcagcgtgtgtctctacagcccccaaaagttccttccaggatggtgccccggcccaaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcagctttctgaagatgagagtgacttggagatctcctccttggaagatcttcctctggacctggaccagagagagaaacccaagcccttgtctcgctcaaagctcccagagaagtttggcactggtccacagagctctggccaacccagggtccctgcctggtgattcaccccagaagctagctggctagagggttagcctggctggggccagctcaggtccacttcaacagaagaggctgctgggcctcttgtcttcacaaacaaccaagagatcatcctcttggagagaagcagtgcagggaatggatatgatctcatccctcctgacctgtgaggggccctgctgtagatggccacaggtgcctgactaggagcccctaggtccccaggcttgagaaagggttaaaatagaacctccaggtagttttcttcctctacctccacatccccccaagactgaaaagagtcactaactctcttttcccaagccttttataaaactgcaggaacactgtggagatggttcctatctggggtccttttggggacatatgcctcagtcagtcattcagtgattgatccaaaattatttactgagtgcctacctactctgcgccaggctctctagcctctcactactgagttagggtgcaggcagaggctggggcagaatgtttacagccagtgccagcacaaggtagtaatctagtgacagagaacagggtgttatggggagcatatgagaggccatctatcccagcctgggtgatcctggagagtttcccagggttgtgatatgtggcaggcctactcatgggtgggaagggaggatggccacttggctggaccttgtatccccaaaggaccacacgtgtaatttttgatattatttccaaaatcaggttttatacatagccattgtatatttttagtgtgaaaaacattaatatattatatgcaaacatttaaatatagtacaatgtttttaa

SEQ ID NO: 2850 - DNA, 571 bp, Homo sapiens
cccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttg

SEQ ID NO: 2851 - DNA, 2107 bp, Homo sapiens
aggtttgtaaatgattgcctggcagccaccttggaaacttggctccctcaagttctcctcttgactgcattcttgaggaagcagaagagacagacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggctgaagaggaggaggaagaggaggggttgctcttgctgtctcacgggtggcagagtcggaagaaaatccacgtataagtggacccatggctgttcaaccccacgttgtttcggggtcaactgtatttcaaacattttctgatcttgaattactgtaagaaactcattttacattgtgaccc

SEQ ID NO: 2852 - DNA, 827 bp, Homo sapiens
aaaccggggcaagtccagcctctcagcaaggccaggaagccattcacttggatcctggattttactaacggattaaacgtggcattcccgccttcccccatccgttacagacctaaaaatagctcgtccgagaggggccgggagaggctccacctcttcttgaggtggggcggggcggctgtagtaggagctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagca

SEQ ID NO: 2853 - DNA, 1957 bp, Homo sapiens
aggtttgtaaatgattgcctggcagccaccttggaaacttggctccctcaagttctcctcttgactgcattcttgaggaagcagaagagacagacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggtacactggggagagggcttgctcagggctgt

SEQ ID NO: 2854 - DNA, 600 bp, Homo sapiens
gaaggccggggccggccagaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttaggttcacctccatttctcaatgtgaaagctttacatcattaa

SEQ ID NO: 2855 - DNA, 2045 bp, Homo sapiens
agcacttcctggccggcgtggggcctggcagccgcaggctggcgttggaccccgcaggggcgagccaaggccctcgcagagggctggacgcgcaggggctgtggggcgcgagctcccgtgggcccccgggcggcgctgagcatgccgggagtgggagtccccgcggccggctcccggcactgccccggagccgagggccgcggccgtccgaggacgagggcggagccgccgccgcgcctgcgcagaaggccggggccggccagaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttagacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaa

SEQ ID NO: 2856 - DNA, 1337 bp, Homo sapiens
gattgcgtcacttccgggcctcagcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 2857 - DNA, 1985 bp, Homo sapiens
agaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccaaaagagttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgac

SEQ ID NO: 2858 - DNA, 7801 bp, Homo sapiens
tggcagctgaacaggggcactgaggtgtcggccggcggggcagtggcccggagcggggggcgggggcgttgatcatgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcagcctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaaattcttctctacccatttgggcttaagacaattcccagaaagtgttttcattatttaaaaaataataatagtaaatgaaagcaattttagaggtggaaaataccttagaatggaatcatttgcattatttgacaaatgagagaagtgacatgacttgcctaaggtcatcctgcaaagttagtggcagagttaggacttgaattccagtcttctaattccttggtcagggcaatttctactgtgttatgctgtctgttagaaataatgacttatggacactttgtctttaagttgtattattgtaaatacccttaaactggccaatagattttagaaaggcaggcatgggagtagatgctgagaattctagccataagaagaaaagtattttaaatcttacagaaatgtttaaacaacccaaaatacatgaataaaaatgacatttctttgtaggacctgccaactaactattcacacacatttatagaggttataaggatcttggctctagaacaaatttttgaaattagatcattttaccatggatgttaacaaaattggaaattttttgtcactgagaaaattatcacaaagcacagtaaatacatatacttaccatacattttgtaaaaaacacattttttaaagaaaatagggatgggtatggtggctcacgtctgtaatcccagcactttgggaggccaaggtgggaggttcacttgagcccaggagttccagaccagtctgggcaacatggcgaaaccccatctctaccaaaaatacaaaaattagatgggcatgttggtacacgcctgtagtcctagctactcaggaggctgaggtgggaggatggtttgagcctgggaggcagaggctgcagtgagccaagattgcactattgcactccaccctgggcaatagagccagatcctgtctcaaaaaataaaaatagactgggcatggtggctcatgcctgtaatcccagcactttgggaggctgaggtgggtggatcacttgaggtcaggagtttgagaacagcctagccaacatggtgaaaccctgtctctaccaaaaatacaaaaatcatagccaagcgtggtggcaggtgcctgtaatcccagctactcaggaggctgaggcaggagactcgcatgaacctgggaggcagaggttgcagtgagccgagatcgcaccactgtactctagcctgaccagcagagcgagactctgcctcaaaaaaaaaaaaaaaaataaaataaaataaaattagttttggaggtgaaaacacccaaactgttattatttaaaaatacctaccaagtactgtggtcatattgacattcaaaagaagtttcataaatcgtatcaactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatc

SEQ ID NO: 2859 - DNA, 3862 bp, Homo sapiens
aaagtggagacaccagtacatactcagcctcacaggactgactggtcaggccactcatccccaggcacgcggccaccggtcactgacaactacagaccgactctgccacccagatcaggtgcccagatgctcagtcgctcacacaggtaactactcgctccctacctccgttcccgggactgcggcgccccaaacccggcggtgtctcagctttcccggtccccggcggacggtggccgaggggcggcgcgggtttccagccggtggggttaggccgctgcacgccggaagtggcagctgaacaggggcactgaggtgtcggccggcggggcagtggcccggagcggggggcgggggcgttgatcatgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcagcctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctc

SEQ ID NO: 2860 - DNA, 3379 bp, Homo sapiens
tctcgccgcacgctgactttgctctcactgcccggccagacgcacttcccgccttcgcctaggtctgcaccgccaccgccgccctctcccgcgcgtccctcacccggtccgccactgccgcgcctcagaatccgaaggctcggttccagcgcagccatccacgccgccgccacgaccgactccggagccacgcgctgcaaccgccaccaacgccttgccgccgccgctcgcccgccgcccaccatggcccagcagcaaacaggtagcaggaaacggaaagcgcccgcggtcgaggcggacgccgagagctcgccgtcgcagggcttggcggcagcggacggtgaggggccgctgctactcaagaggcagaggcggccggcgacgtatcgctcgatggcgcactatctgaaggttcgggaggtaggcgggtggggccccgccaggctccagggcttcgatggcgagctgcggggctacgcggtacagaggctgcccgagctgctgacggagcgccaactggagctgggcacggtcaacaaggtgttcgcgtcacagtggctgaactccaggcaggtggtgtgcggcaccaagtgtaacacgcttttcgtggtggacgtggagtcaggccacatcgcgcgcattcccctcttgcgggacagtgaggccaggctggcccaggaccaacagggctgcggcatccatgccatcgagctgaatccctccaagacgcttctggccaccggcggcgaaaaccccaacagcctggccatctaccagctgccctccctggatcccctgtgcctgggcgaccgccatggccacaaggactggatcttcgccgtcgcctggctgagtgacaccgtagccgtgagcggctcccgcgacggcactgtggcgctgtggcggatggacccggacaagttcgatgacactgttgcctggcatagcgaggtgggtctccccgtatatgcccacatccgtccgagggatgtggaggccatccccagggccatcatcaaccccagtaaccgcaaggtgcgggccctggcctgcggcggcaagaaccaggaactgggagcggtgtccttggacggctacttccacctgtggaaagccgggagcgcactatccaggctgctgtccatcaggctgccctacttccgggataatgtgtgcctgacctactgtgatgatatgtctgtgtacgccgtgggctcccattcccacgtctctttcctggatctgcgccaggaccagcagaacatccggcccctgtgttctcgagagggtggcacaggcgtgcggtcgctgagcttctaccgccacatcatcactgtgggcaccggtcagggctccctgctcttctatgacgtccgggcccagaaattcctggaggaaagagcctccgccaccctggagtcctcttcgggacctgcaaggaggaagctcaggcttgcctgtggcagaggctggctcaaccacaatgatttctgggtgaattactttggtggcatggaagtgtttcccaatgcgctctacacccactgctacaactggcctgagatgaagctctttgtggctggggggcctctccctgcaggcctccatgggaactatgcaggcctctggagctaaggatgaccgccttgtactccaggtggaaccagcccagcttaatttgtactcctccaagcagagagagtgagtggtcctttggtcaatgaaaacttggctttaagactttttgactcctttccaacaccatcttttggaattttcatacaaagaaatttggttaatcgttaatctttagttgcattctctctttgagtgattcatacattctgtttctttaagaagatgcagtcatggtctttcagttatgtatatttgttttccttgtttttcctcgttaccaatattacaacagcattgttttcagttatttttcattgcagatacgaagagaaaattttctagtaagcaaggtgttcctacatcttttctggagagcttaccatagttttatagcattgttcaattggaaaagtacattccaagttctagattacctacgtttggaaacacttaatttacaaattgtgatcttagtgtatatagtttttacgttgttggtgctaaagtgcttttttgaagtttattctctttcaaaataagttatcatagaatcttgtgcttgtatcaaactcctaattggtcggaacactttaggagtgcaggggttctgcttcattgcattttcagaattaacctgaaagttgaaacaaccatttttttttatttcaaaacttatttaagttgttatcacctgtccttaaatagataaaagaatgtgtattttttcacttgttgccttagtactatcaagacttgtgaatatatttgaatgtatgttgtttgaaaaacttgcacagggcattggagccatcatgaaaagcaggaaatgtaaacgtggaatgtatggcaggctgggcagaatgtatactgatccagggtatagactagatatttttgctgttgctgtttttattataaaatgttatatttgaggatatttaacattttccaattctgcttaagaggtaattcacaataaaaaaaacaaagaccaaaaatagcacattctgaaaaaaagattcttaataagattttattttgtgaagttcaaagattctttcctaaagtataacgtgttgttaaaaagtagtggtgttataactctcaatgtaatagtatgcaatatcaagaacacaggaagttcgtttcaagataggtgagatttaaaataaataggatgaggttgaagaaaagtatattggagcgcagataaatataaattgtggactgctatgaaaacaggttgtacttctccatatgtgagactactggaagtgagaagcaatatttgtcatttctaaaactggccaggctgtgctgacccaggattagtaatttgttatgtctgttttcccttagatgtttgggcactcagatgctatcttggtgcacacacacaacattgctgttcagtcacaaatccgaacaacttaatataataaattgtactaaaagtcatttaagaaataccaaaaagtaagcttttgtttctaaccattgttataaaggctaatataattgttgttatatagcagtaagatatatttgtgtgcatgcgtctccaagtcagttgtaaatgtcttgagaacagagaatacaattgtcatctttatattgcctcatttctccactaatacttagcaaataaaaggcaataagtaaatatgtactggttgaatgcctctggagacctagagtttaaagttttaagtcaataaataaataaatatttactcttaaa

SEQ ID NO: 2861 - DNA, 1421 bp, Homo sapiens
gctgctgcagatcgcccgccgcccaccatggcccagcagcaaacaggtagcaggaaacggaaagcgcccgcggtcgaggcgggagccgggagctcgtcgtcgcagggtttagcggcggcggacggagaggggcctctgctacccaagaagcagaagcggccggcgacgcgtcgcaggctggtgcactatctgaagggccgggaggtaggagcgcggggcccagccgggctccagggcttcgagggcgagctgcggggctacgccgtccagaggctgcccgagctgctgacggagcgccagctggacctgggcaccctcaacaaggtgttcgcgtcacagtggctgaacgccaggcaggtggtgtgcggcaccaagtgtaatacgctgtttgtggtggacgtgcagtcaggccacatcacgcgcatccccctcatgcgggacaaggaggccgggctggcccaggcccaccagggctgcggcatccatgccatcgagctgaatccctccaagacgcttctggccaccggcggcgaaaaccccaacagcctggccatctaccagctgcccaccctggaccccctgtgcctgggcgaccgccatggccacaaggactggatcttcgcagtcgcctggctgagtgacaccgtagctgtgagcggctcccgcgacggcaccgtggctctgtggcggatggacccagacatgtttaatggcagcattgcctggcacagcgaggtgggtctcccagtatatgcccacatccgtccgagggatgtggaggccatccccagggccagcaccaaccccagcaaccgcaaggtacgggccctggccttcagcggcaagaaccaggagctgggagcggtgtccttggacggctacttccacctgtggaaagcccggagcacactatccaggctcctgtccatcaggctgccctactgccgagagaatgtgtgcctgacctactgtgatgagttgtccctgtacgctgtgggctctcagtcccacgtctccttcctggatccgcgccagcgccagcagaacatccggcccctgtgctctcgagagggtggcacaggcgtgcggtcgctgagcttctaccagcacatcatcactgtgggcaccggccatggttccctgctcttctatgacatccgcgcccagaagttcctggaggagagggcctcttccagcctggactccatgccggggcccgcagggaggaagctcaagcttgcctgcggcagaggctggctcaaccaagatgacgtctgggtgaactactttggtggcatgggagagttccccaatgcgctctacacccactgctacaactggccggagatgaagctctttgtggctggggggcctctcccttcaggcctccatgggaactacgcaggcctctggagttaagg

SEQ ID NO: 2862 - DNA, 1652 bp, Homo sapiens
tcgcaccagcttcttggtcttagagatcctgagctctcggctgacgcggaagcgcagccatccccaccaccgccgcccaccatggcccagcagcaaacaggtagcaggaaacggaaagcgcccgcggtcgaggcgggagccgggagctcgtcgtcgcagggtttagcggcggcggacggagaggggcctctgctacccaagaagcagaagcggccggcgacgcgtcgcaggctggtgcactatctgaagggccgggaggtaggagcgcggggcccagccgggctccagggcttcgagggcgagctgcggggctacgccgtccagaggctgcccgagctgctgacggagcgccagctggacctgggcaccctcaacaaggtgttcgcgtcacagtggctgaacgccaggcaggtggtgtgcggcaccaagtgtaatacgctgtttgtggtggacgtgcagtcaggccacatcacgcgcatccccctcatgcgggacaaggaggccgggctggcccaggcccaccagggctgcggcatccatgccatcgagctgaatccctccaagacgcttctggccaccggcggcgaaaaccccaacagcctggccatctaccagctgcccaccctggaccccctgtgcctgggcgaccgccatggccacaaggactggatcttcgcagtcgcctggctgagtgacaccgtagctgtgagcggctcccgcgacggcaccgtggctctgtggcggatggacccagacatgtttaatggcagcattgcctggcacagcgaggtgggtctcccagtatatgcccacatccgtccgagggatgtggaggccatccccagggccagcaccaaccccagcaaccgcaaggtacgggccctggccttcagcggcaagaaccaggagctgggagcggtgtccttggacggctacttccacctgtggaaagcccggagcacactatccaggctcctgtccatcaggctgccctactgccgagagaatgtgtgcctgacctactgtgatgagttgtccctgtacgctgtgggctctcagtcccacgtctccttcctggatccgcgccagcgccagcagaacatccggcccctgtgctctcgagagggtggcacaggcgtgcggtcgctgagcttctaccagcacatcatcactgtgggcaccggccatggttccctgctcttctatgacatccgcgcccagaagttcctggaggagagggcctcttccagcctggactccatgccggggcccgcagggaggaagctcaagcttgcctgcggcagaggctggctcaaccaagatgacgtctgggtgaactactttggtggcatgggagagttccccaatgcgctctacacccactgctacaactggccggagatgaagctctttgtggctggggggcctctcccttcaggcctccatgggaactacgcaggcctctggagttaaggatggacgccttgttctcaaagtgcacaggtttacctttcagttccgcctgactttccttcttcatgctgcatttgtgcttttaactttgtgtggcttttgtcttccaggtggaaccagtccaacttacgtgtgcttaatgtattaggcagagaaagaaagagagagagcgggagcga

SEQ ID NO: 2863 - DNA, 2256 bp, Homo sapiens
gtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctg

SEQ ID NO: 2864 - DNA, 4548 bp, Homo sapiens
cggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttatatagaattggtgataggatcacaacttctgaggtcccagcaagagtcctaacatctagcagctctaccaccaggacaggccccctaaaactaattccaacaagcacctctgaagtcttctcattcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaactacacaaaggaaaatggcagggctatgaatttctttcccagcttttatatagatgtgcctacatatgacactctttagggttccttttattttttctttttttttttttttgaggtagttgaattaaactgggtaactacacaaaggaaaatggcagggatatgaatttctttcccagcttttatatagatgtgcctgcatatgacactctttagagttcctttcactttttcttttttttggaagggggcggggaggcaggaggagtgcagttttaagcctagcctatactactacaaacttattatggtacttaaaattacagcatgaacgttctatatcggagtctcccaccaggctgtctctgactaaatcagcctataagatcatcccttgggattaaacaaacacctgttctgtagggaatgtgtttcctgaatcttggtactcagacttttgtcaagagtaaataacatttcaaaagatgaatggaaaaatgattaagagagcatttctgctttcagcattaactgctaatggattaaaattttaatctgtatagcatttcctggagtaaaagctcaagtactttccacatccattgcaaacttttcaggaacccttctaattttttttttttttttttttttgagacggagtcttgctctgtcgcccaggctggagtgtagtggcatgatctcagctcactgcaagctctgcctcccgggttcgtgccattctcctgccctgcctcccgaatagctgggactacaggcgtccaccaccactcctggctatttttttgtatttttagtagagacagggtttcaccgtgttagccaggatggtcttgatctcctgacctcgtgatccacctgcctcggcctcccaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatatactctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccaacagtttgggaggctgagggcaggtggatcacttgagatcaggagttcgtgaccagcctggccaacatggtgaaagcccatctctactaaaaatataaaaattagccgggcgtggtggcatgtgcctgtaatcgcagctacttgggaggctaagacaggagaattgcttgaacctgggaggtggaggttgcaatgagctgagatcgcgccactgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgctgaa

SEQ ID NO: 2865 - DNA, 2589 bp, Homo sapiens
cggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttatatagaattggtgataggatcacaacttctgaggtcccagcaagagtcctaacatctagcagctctaccaccaggacaggccccctaaaactaattccaacaagcacctctgaagtcttctcattcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatatactctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccaacagtttgggaggctgagggcaggtggatcacttgagatcaggagttcgtgaccagcctggccaacatggtgaaagcccatctctactaaaaatataaaaattagccgggcgtggtggcatgtgcctgtaatcgcagctacttgggaggctaagacaggagaattgcttgaacctgggaggtggaggttgcaatgagctgagatcgcgccactgcactccagcctgggcaacagtgagacaccgtctc

SEQ ID NO: 2866 - DNA, 2024 bp, Homo sapiens
atgagatcgtccctattgacgtcgacagacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagatt

SEQ ID NO: 2867 - DNA, 2360 bp, Homo sapiens
gcacgcttcgctccaactcctgcagagctgagccggaggggaatccggaagggacacgctgaacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaatcatggtgtgacatgcacttctgtgaatgacttaggagatcatgagcttgggctgct

SEQ ID NO: 2868 - DNA, 1521 bp, Homo sapiens
acgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaaggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctg

SEQ ID NO: 2869 - DNA, 2374 bp, Homo sapiens
gctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaag

SEQ ID NO: 2870 - DNA, 4764 bp, Homo sapiens
acccggacggaacttcctgtcacggaaaagaacatcctgtcacggagaagaacatcctgcagaatttcctgtcacgaggaacattccgcaggaggaaatggaggctgaaaggctgcgactcctcgaggaagaggccaagctgaaaaaggtagccagaatgggatttaatgcatcttccatgctccgaaaaagccagctaggtttcctcaacgtcaccagttactcccgtttagccaacgagctgcgtgtgagctgcatggagcggaaaaaggtccaaattcggagcttggatccctcctctttggcgagcgaccgatttaacttcattctggcgagtaccaacagcgaccagctcttcgtagtgaaccaggtcgaagtcgaaggctccaagtacggcatcatcagcctgcgaactctgaagatcccttcgttccacgtgtacgtgctcagaaacctctacgtccccaaccggaaggtgaagtccctgtgctgggcctcgctgaaccagttggactctcacgttctgctgtgcttcgagggaatcacagatgctccaagctgtgcagtgctgctcccagcgtcgcggttcttaagtgttcacacaagagttaaccagcctggcatgctctgcagtttccagatcccagaggcctggtcctgtgcgtggtccctcaacacccgggcatatcactgctttagtgcaggcttgtctcagcaggtcctgttgaccagcgtggcgacgggacaccagcagtcatttgataccagcagtgatgtcttggcccagcagtttgctagtacggctcctttgctgtttaatggctgtcgctccggggagatctttgccattgatctgcgttgtagaaatcgaggcaaggggtggagggccactcgcctgttccatgactcagcagtgacctctgtgcaaatcctccaagaagagcaatgcctgatggcatcagacatgactggaaagatcaagctgtgggatctgagggccactaaatgtgtaaggcagtacgaaggtcacgtgaatgagtccgcctatctgcccctgcatgtgcacgaggaagagggaatcgtggtggcagtgggccaggactgctacacgagaatctggagcctccatgatgcccacctgctcagaaccatcccttccccgtactctgcctccgaggacgacattcccagcgtggccttcgcttctcggctcgggggcatccggggagcagcaccagggctgctcatggctgtccggcaggacctttattgtttccccttcagctaattctgcaggtggcagcgcggccgaatgtggatttgacttaaggaagttaagagtatcttattaccgtttctgtgagagcattttaagagacgtgttgtatatagatcgcatccatccggctgccaggggtaaggtgttaagagttttatgtggagacgttcttgtaaagttatttcagttaaactgtggacttaacttgaaagtccttttcataaaaggtacctgtttcctcttgttgaatgccttagaacagttaaccacctccccaaccctttttttttttaaataattaagacttttctaaggactgaagattggcaaaaactaaaataaattaaagcagcttctttcactagtagccctttagagaagcataatgatggtactggtaagactgtttgactaatcatacagggtcccaggcatctgcgcttgaggaagccagtgggagtggagacaagggagaggtaatttctcagagtctctacagaaatatttaaggctggagtttggaatcattaaatttggccttctcaaactcaatagcagatctcttaaggttctccttttattgttatcatccataggcattggaaggaaagatggatctttttaaatactagaagttttaaacagtccttgatgtgcttttgttgaggtacctttcagaatgtaaggtacagcagctccggtttctattatggtgacttgaagttcagattcaaggaattggctttgactttttgtaatctaggagcagcagtttgtgagagatttattaaaaatgttaaagagcctgtttttctactaagcaaggaagaaaaaaaacgtgtaataaggttagttgctacttcttaatagccaaagcctggaaatgatctgaatttcgaaaatgctaaaattcgtgatataatcatacaatcggatactgcataataatagaaaataaggcacacttgctatgtgaaacagtatggaccaatctcaacatgttgactgaaattaggtagaaatgagtacaaactgtatgattcaattctaaagttcaaaagcagtaaaaacttgtctatggtgattaaaggtagagtagtacgtacctctgtagaaagaaaggatttttttttctttttctttttaggatgtttgagaagtgacatggggaagctttaggaatgctgagttttctttatcttgacacttgatacatacgtaattcatatatctatatgcttcacgtttttatagtttactgtatatatgttattcctcaaaaaataaaaataagcaattaggacactattgtagttaggcaagggacaatgatgccttggacctgcatgtgtgagaagtagaaatgatcagaaatgattgcattggaagatcattcgaaggtagtattattgataaggcttgctgatgagagtaaactagaaagtgaaagaaaaaaggatggcagcttttttttttttttttttgagacggagtctccttctgtcgcccaggctggagtgcagtggcgcgatctcggctcactgcaagctctgaggatggcagcttttttgttaactttagaactggtagatgatggtgtcgtttactaacctggggaggatgaggagaaaaaactttaggtgaagggaatgatgctgagttttagacatctactaaacctccaattggagatacaaagtattctgcagatcaggggtcatgtcatggctggtaatacaaatttggtgacttcaatacatagaattaaaatagatgggatagatgtgctttatatgacatagatgaggttaatgtaattacatattgatagaagatgagtagatcaatagagaagatatgggagtatggttaggcacagatttttggaatcctttcagtcagttttttatactaacttgatatgtgacatgagaaattgtgtaagctttacttgctgttgtttcttcagtgtaaaatgtcttagataataaaactaaatgataaagtagatacagggttaaaggatatgtatcttgtcccttttacattgtaagcattcaaaataaaacaaaacaattaatgaagaaaagacattgcaatcattcagtaagaactagctgcagacatatatatgtatatatatatatgtctgatactgatatgtcatttatttggcaattgacaaaaaatgactacataacttgataaactgtttatcctcatttgcaaagaaaacaaatgcaaaaaaaaaatcagtaagaaaaacacacctaaaagaaagggaggcaatagtcttgaataggagaaaaagaggagatccaaatggctaatatacatttgaaaaggcatccaacttcttttattgtcaaggaaatgcaaattaaaaccacaatgccacaccactttcactataatggttaaaataaaatagatcaggtggagtgacgttgggaattaaaagagaagcaaatgttggtgcagttgtgagcaaatagaactttcatatactgttgagtgtatactggtacaagcacttggaaaagttagtaattgctaaagctagaagtttgcatactctatgacccagtcatttcagtcctaggaatatattaatcagaaatgcatacctgtgtccaccataatttgttaatagctccaactggaaactacccaaatgttcattaatagtagagtggataaattgtgggatattaacacaatggaatcctttttgcagtgagaatgagcatagcactatggacaaatcctgcaaacataatgttgaaataaagatgccaaacacaaaagagcacatattgtacaactaatgcacataaagtccctaaacaggcaaaatgaatctatgttcttagaagcaggattaatggtatacttgtagggcagaagagtagtgaccagaagaagattctaggaagctagcaatgctggtgtcatgccagacccctagtgactccaatagtaatggcactgtgtccgagagtccaaagaagatgcgtagacagcgaacaagacttgggtttattgggggaacttatatatagggatggtccagtggtagtaggctggacagaagaaccactactgtttgtaaaaagcatgcagtttatatagcattttcatttagcacactccacctagcaacctccatttaacccaaagcaaaggaccttgatcccctatattgcctgtgttgtaagggatgggctgggggttcagacgtccttcatagataaggagtgaaactcagggttagtcgctcctgtttccttagtttgggattctgagcacacattcgttttagatcacagggtcgttctcaggatatggttgttactgctgtcaggtgcatcctctctatagcggggtactggctacacagtttttgttcactagtgataattgttagagctatgcccttaatatatgtcttgtgtgtattatacttcaataaaaagttaaatttt

SEQ ID NO: 2871 - DNA, 3324 bp, Homo sapiens
gttcttccgtgccaagtcgtgcttgtaaagaagcggtacttcctcttactcccgggacagaacttcccctcaggagggagaacatccgccgaacgaaatggagagcaaaagaccgcgactgctcgaggaagcagacaagcagaaaaagacagtcagagtgggactcaatgcaccttccatgctacgaaagaaccagctaggtttcctcagattcgccaactattgccgtatagctcgcgagctgcgtgtaagctgcatgcagaggaaaaaggtccagattcatagctgggatccctcctctttggcaagcgaccgatttaaccgcatactggcgaataccaacactgaccagctcttcacagtgaaccaagtcgaagctggaggctccaagtacggcatcatcaccatgcgaggcctgacgacccctgagctccgggtatacccgcacaaaaccctctacgtccctaatcggaaggtgaattctatgtgctgggcctcactgaatcacttggattcccaccttctgctgtgcttcgtgggacttgcagatactccaagctgtgccgtgctgctcccagcgtcgctgttcataggtagcttcccaggaatgcgtcggcctggcatgctttgcagtttccagatccctgatgcctggtcctgtgcctggtccctgagcatccacgcgtatcactctttcagtacaggcttgtctcagcaggtcctgttgaccaacgtggtgacgggacaccagcagtcatttgggactagcagtgatgtcttggcccagcagtttgcaatcatgactcctttgctgtttaatggctgtcgctctggggagatctttggcattgatctgcgctgtggaaatcaaggcagcgggtggaaggccatttgcctgtcccatgattcagcagtgacttctctgcaaatcctccaagatggccaattcctggtgtcatcagacatgactggaactatcaagctgtgggacttgagggccactaaatgtgtaacacagtacgaaggtcatgtgaataactccgcctacctacccgtgcatgtgaacgaagaagaaggagtcgtggcggccgtgggccaggactgctacacgagaatctggagcctccgtcatggccacctgctcacaaccataccctccccataccccgcctcggagaacgacattcccagtgtggccttctcttctcgcctcgggggcttccgaggagcaccagggctgctcatggctgtccgggaggacctttattgtttctcctacggttaattcttcaggatgcagcccggaggaacgtggatttgacttaaagaagtaaagagcatcgtattaccgtttctatgagcgcattttaagagatgttcggtgtttgtagatcccatccatccggctgctaggggtaaggtgctgttttatgtgaagatagttctgtaaagttgtttcagttaaactgggctgagagagcttgaaagtccttttcataaaagataactatttccttttcttgttgaataccttagaatagttatccccccctttttttttttttttaacaaaaaaacacttttctaaggactgaagattggcaaaaactaaaataaattaaaactgcttacaccagaagccttttagagaagcatgagactgtttgactagtcctacctgggttccggaaatacatgcatcatctgtacttgaagaggccagtgggagaggagaggagggggaggtcatttatctgagtctctccagaagtttttaaggctacattttggaatcattaaacttggccttctcaaactcaatagcagatctctgagattctccttttattattttccataggcaatgggaggaaaggtggatctttttaaataatagaagttttaaacagtccttaacgtgcttttgttgaggcatcttccagaatgtaaggtacagcagctccggtttctattattgtgacttgaatgtcaggattcaagggctcagtgtcaaagataattggctttgactttttgtaatctaggagcagcagtttgtgagatgtttattcaaagtgttagcctgtttttctaccaacaataagctagaaaagacaaaaaaaacaaaaaacaaaaaaacgtgtaataaagttagtggctacttcttaatagccaaagcctggaaatgatctcactttacaatatgctaaaattgataaataatttgtgctgtagtcatacaattggataaagcataatataaaataaggcacaattgctatatgaaactgtggattaatctcaacatgttgattgtaaatgtaggtagaaatgagtacaaactgattcagttctaaagttccaaagcactaaaaacttatctatggtgattacagtttgaatagtaggtatctctgtggaaggaagaaaggatattgtttgtttttttcccttttatttttaggatattgtttggaaagtaacacggggaaactttagaaatgctgttttctttttcttgatccttgatacatacatattttgtatgtctatacacttcacactttatataatacctcaaaaataaaaatatgaaaacagtacactgttgtaggttggtcaggaaagggaatgattgtggcttggacctgactatgagaagtagaaataatcagaaaaatcagaaatgattgcattggaagatcattcgaaggtagtattagtaagatttgctgatgagagtaatctagaaagtgaaagacagcataaagattgcagcttttttgttaactttaggactggtggatggttggtgtcatttactaaaatggggaggatttgaggtgaaaaaattttaggtgaagagaataatgctgagttttaggcaactattaaaatgtccattctgtagattagaggtgatgtcaggacataaatgaggttaatgtaatattacatattgatagaggaataggtcaatagagaagatacaaaagagtggttaggtgcatagatttttgaaatcagttaaattagtttttgatacttgatgtgtgacaggggaaactgtgtaagctgtacttgttatttctttgtaaaatgtcttagataataaaactaaatcataaagtagatattggtttaaaggatgtatacattgtcccttttacattgtaagcattcaataagaactagctgcggatgtaattttttttaaaaaagtccaaaagcagctatgggcagttgacaaaagaaaatgtaatgactacgtaacttgcgaatctgtttaccctcacttgcaaataaaataagtgcaaataaagc

SEQ ID NO: 2872 - DNA, 3457 bp, Homo sapiens
gcttacctactgccttctccgaccgtccgtcctcggggcaggcgtgctctcttccctgagcttttaggggttggcttttccagttccagatcagctacagcaaacatcgttcgagatgtcccaccaagagggcagcacaggtggcttaccagacttagtgactgaaagcctgttcagcagcccagaggagcagtctggagtagcagcggtgacggcggcctcctcagacattgaaatggcagccacagagccatcgaccggagatggtggtgataccagggatggtggtttcctgaacgatgccagcacagaaaatcaaaacacagactcagaaagttcaagtgaagacgtcgaacttgaaagcatgggtgaaggtttatttggttacccgttagtgggagaggagacagaaagggaggaggaagaagaagagatggaggaggaaggggaggaggaagaacagcctcggatgtgtccacgatgcggtggcaccaaccatgatcagtgtttgttagacgaggatcaggcgttggaggagtggatttcctcagagacatctgccctgccccgatctcgctggcaagtccttactgctcttcgccagcggcagctgggttcaagtgcccgctttgtatatgaggcctgtggggcaagaacctttgtgcagcgtttccgcctgcagtatcttcttggaagccatgccggttctgtcagtaccatacactttaaccagcgtggcacccgactggccagtagcggtgatgacttaagggtgatagtgtgggactgggtgcggcagaagccagtactgaactttgagagtggtcacgatattaatgtcatccaggctaagttctttcctaactgtggtgattccactctggccatgtgtggccatgatggacaggtacgggtagcagaactaattaatgcatcatattgcgagaatactaagcgtgtggccaagcacaggggacctgcccacgagttggctctggagccagactctccttataagttcctcacttcaggtgaagatgccgttgtgttcaccattgacctcaggcaagaccggccagcttcaaaagttgtggtaacaagagaaaatgataagaaagtcggactgtatacaatctctatgaatcctgccaatatttaccaatttgcagtgggtggacatgatcagtttgtaaggatttatgaccagaggagaattgataagaaagaaaacaatggagtactcaagaaattcactcctcatcatctggtttattgtgatttcccaacaaacatcacctgcgttgtgtacagccacgatggcacagagctcctggccagctacaatgatgaagatatttacctcttcaactcctctctcagtgatggtgctcaatatgttaagagatataaggggcacagaaataatgacacaatcaaatgtgttaatttctatggcccccggagtgagtttgtcgtgagcggtagtgattgtgggcacgtcttcttctgggagaaatcatcctcccagatcatccagttcatggagggggacagaggagatatagtaaactgtcttgaaccccacccttacctacctgtgttggcgaccagtggcctagatcagcatgtcaggatctggacacccacagctaaaactgccactgagcttactgggttaaaagatgtgattaagaagaacaagcaggagcgagatgaagacaacttgaactatacggactcgtttgacaaccgcatgcttcggttcttcgtgcgtcacctgttacagagagctcatcaacccggctggagagatcatggagctgagttcccagatgaagaagagttggatgagtcttccagcacctcagatacatccgaggaggagggccaagatcgagtgcagtgcataccatcctgaaggcctcatatccagtccagctagatgccacctaagtacactggactttaaaattcagtttgactaatttagaattgtcaattgattaacagatttgctttttgtcttctgtttttgttaccccttatatgagtgcatacacaacttatttatgcctcttttcctttgttcccttataattgacctctaaaattgcataattttgttgaaaaaattaatggccttattagatgtatctactcatttcagacattctgaaagctattactttttagttttttcattttttaccaatttattttgaagataaagttcttcagttgagttgaaaatttcataaacgtgtttattctttagaggtaaaataaggcaaaccatagttctttgaatactgacacacacatacacacagtctcagaaaaggaaaagagaagtagtgtgtagattaattcctaacacttggccacacacacacacagcttcaaaagttgtagtaacaagagagaagaataagaaagtgggactgtatacaatctctatgaatcctgccaatatttaccaattcgcagtgggtggacatgatcggtttttaaggatttatgaccagaggagaattgatgagaaagaaaacaatggagtactcaagaaattcactcttcatcatctggttaattgtgattttccaacaaacatcacctgcattgtgtacagccacgatggcacagagctcctggccagctatgcacacacacatacacacagagccttagaaaaggaaaacaagaagtagtgtgtagatgaattcctaaccagataattcatctcctcagagcaaataacttgggattatccacattttctgaatcaatatgttaataatattgattaatttgagcacactgaagctggtaagaactaaattaaatttaatcacatgacattgtttactctatgcattaaatgttcttgaagttttatggttgggaactcccacaggattacattccaggaagtcctcctggcgcaagcatctcctataagataccagataggaatataaaaatctctcatatttgaaaacatttattttaattaacttttaagaataagttgcaataaaaattgtttatacttacacataaccatttgatacagttggtagaaaaatcctatttaacatccatgcattgcttaaaatttagctgttttatgagtttgttttgaaaattgttgcaataaaaattgtttatacttacaagtgatgtagttggtagaaaaatcctatttgacatccatgcattgcttaaaatttagctgttttatgagtttgttttaaaaattgttgcagtaaaaattgtttatacttacaagtgatgtagttggtagaaaaatcctatttgacatccatggattgcttaaagttctctcagctgtcctcgagtttaaattgttttaaaaattgtcttaagctttacttaatataaatttaagttactagatgttaaattactgttcaataaaaatattcatttttatttt

SEQ ID NO: 2873 - DNA, 2295 bp, Homo sapiens
tttagaagacgtcttgcactgttcaaatgcagaggaaggcgaatgactcgagtctatggttttggtatactgagcctggggctactggtgtcagcctggtggtagtgcagctcatctgatgcctggggctgcaggatcctagttggttcctgtgacagaccttgggaagctcaatctcagatgtgttttcttaattgaagaaaatcatatcacatgtgaactttctgaccatactgtggagcggtgctaataaggaggaagctgcactgttgcagaggtccattaactctttcaggacggtgtggaatcagtggggaaatctctaattgctactgacacagagcttttaggggcctggcctttgcagttccagatctactacagcaaacatcgttcaagatgtcccaccaagaaggcagcacagacggcttaccagacttagggactgaaagcctgttcagcagcccagaggagcagtctggagccgtggcggcgacagaggcctcctcagacattgacatagcgacctcagagctgagtgtgacagtgaccggagatggcagtgatagcagggatggtggattccccaacgatgccagcacagaaaatcgaagctcagaccaagaaagcgcaagtgaagacatcgaacttgagagcttggaggactttgagcatttcctcatgagtggtgaaagtttattccattaccctttagtgggagaggaggagacagaaagggaggaggaagacgaagagatacaagaggagggaggggaggaggaggaagaggaggaggaggaggaggaggaggaggaggaggaggaggaggaggaagaagaacagcctcgggcgggtccacaaggcagtggcggcaaccatgagcagtattcgttagaggaggatcaggcgctggaggagtgggtttcctcagagacatctgccctgccccgacctcgctggcaggtcgttactgctcttcaccagcggcagctgggttcacgtccccgctttgtatatgaggcctgtggggcaagagcctttgtgcagcgtttccgcctgcaatatcgtcttgcagaccatgtcggctgtgtcaatactgtacactttaaccagcgtggcacccggctggccagtagcggtgatgacctaaaggtgatagtgtgggactgggtgcggcagaggccagtactgaactttgaaagtggtcacacaaataatgtcttccaggccaagttccttcctaactgtggtgattccactctggccatgtgtgcccgtgatgggcaggtacgggtagcagagttaattaatgcatcatatttcaacaatactaagtgtgtggcccagcacaggggacctgcccacaagttggctctggagcctgactctccttataagttcctcacttcaggtgaagatgctgttgtcttcaccattgacctcagacaagaccggccagcttcaaaagttgtggtaacaagagaaaatgataagaaagtgggactgtatacaattactgtgaatcccgccaatacctaccaatttgcagtgggtggacaagatcagtttgtaaggatttatgaccagaggaaaattgataagaaagaaaacaatggcgtgctcaagaaattcactcctcatcatctggttaattgtgatttcccaacaaacatcacctgcgttgtgtacagccacgatggcacagagctgctagccagctacaatgatgacgatatttacctcttcaactcctctcacagtgatggtgctcaatacagtaagagatttaagggacacagaaataataccacagtcaaaggtgttaatttctatggccccaggagtgagtttgtagtgagcggtagtgattgcgggcacatcttcttctgggagaaatcatcctgccaaatcatccagttcctaaaggggagcagagaaggtacaataaactgtcttgaaccccacccttacctacctgtgttggcgtgcagtggcctagatcatgatgtcaagatctggacacccacagctaaagctgccactgagcttactgggttaaagaaggtgattaagaagaacaagtgggaacgagatgaagacagcttgcaccatggcagcctgtttgaccagtacatgctttggttcctcctgcgtcacgtgacgcagagaggtcgtcaccaggactggagaagtggtgaagctgaatttccagatgaagaatcggatgagtcttccagcacttcagagacatctgaggaggaggtccaagaccgagtgcagtgcatgccatcctga

SEQ ID NO: 2874 - DNA, 4538 bp, Homo sapiens
gcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagcttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgtt

SEQ ID NO: 2875 - DNA, 1836 bp, Homo sapiens
gtcggcgcgcgccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctcagtc

SEQ ID NO: 2876 - DNA, 1882 bp, Homo sapiens
caagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccgtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttc

SEQ ID NO: 2877 - DNA, 2648 bp, Homo sapiens
gcacaaggcgcgttcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatattatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgat

SEQ ID NO: 2878 - DNA, 1289 bp, Homo sapiens
accgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcagttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggcc

SEQ ID NO: 2879 - DNA, 2289 bp, Homo sapiens
aaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttatttcccttaattcttataaattaaaaacatcagaaaatgaattattaaataaaagacagtgttttcttttctg

SEQ ID NO: 2880 - DNA, 1977 bp, Homo sapiens
cgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttatttcccttaattcttataaattaaaaacatcagaaaatgaattattaaataaaagacagtgttttcttttctgg

SEQ ID NO: 2881 - DNA, 1976 bp, Homo sapiens
acgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagctgaatattatttgggttgtgcccttctctggaattaatatcaacgcatctcttattgccttgttatacagtctactcaccacaatcaatatgaagtttactccataaacagaggtatggtacaagaggtaacgtgtcatccaaggtgactttcctggcagccaccagtaaactgactccggacagataggactcttttgttgccgccaaggcatacttacaatgacctcagaggctctagggccacagtgtgaaaaccaaccaat

SEQ ID NO: 2882 - DNA, 635 bp, Homo sapiens
tggggcgctaggccgcggcggcagaactggtgcccctgcgcggccttcctcccatccttacagttccccgtgtcccaggcctctacccggaaccggagccccgcccgtctcctagcagctccgtgacgtgaagcgcctcgggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctcc

SEQ ID NO: 2883 - DNA, 2900 bp, Homo sapiens
gctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcaggaaaatacctacaagtctacttggaggaatccccagcattttcaacaggatgtcagaatgaccttgggctatgttggcaaagcacaatgggaagaagacaaccaattgaaggtcaaactaggccttaaaaaaaattgttcttcctaaatgaaactttatgtaagacccaagcttcctttatgtaaaaataggatactcactaggctttggggctgacaatggtttttaaatcttgctaatcttccctggaatgaaaccagcatgactcaaagagaaaaagagagtctataatattttctaatccctgagttcttttctttatatattaaaaaggattactaggctgggtgtggtggctcacgcctgtaatcccagcactttgggaggccgaggggagtggatcacctgagttcgagaccagcctaaccaacatggagaaaccctgtctctactaaaaatacaaaattagccaggcgtggtggcgcatgcctgtaatcccagctactcaggaggctgcggcaggagaattgcttgaactcgggaggcagagccaagatcgcaccactgcactccagcctgggcaacaagagtgaaactctgtctcaaaataatattaatgataataataataataataatagggattacttgcataattgttcttttaaaattattggcagtattgctgaatgtatttagattttttcaccaagtgacaacaactgaattcataaagattcatcaacaagacctgataaaaaaaaatgtaagcatattatagtggatacttccaagactcttggtctaacatgtattagaaagcagaaggagcccaggcacaggggctcccgccggtaatcccaaagctttgggaagccaaggcaggtggatcgcttgagctcaggagttagagaccagcctgggcaacatggtgaaatcccgtcaccacaaaaaaatgcaaaaattaactgggcgtggtggcatgcacctgtagtcccagctactctggaggctgaggtgaggggaatcacctgagccgggggaatcacctgagcccagggaagttgaggctgctgtgagccatggtcatgacactgccctccagcctggacaacagattgagaccctgtctcaaaaaaaaaaaaaaaaaaa

SEQ ID NO: 2884 - DNA, 6754 bp, Homo sapiens
agagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctatggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatgtctggtcgtgctggaagaagaggtcaagacctgcttggaaatgtgtatttctttgatatcccattgcccaaaataaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtatgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagatatcagctctgctattttctaactgaatgactttaagttatgtaatatatctgagctttaacttcatttttggcaaaaccggagtaaaaatgaatacctctagttgttttgaggattaaatgagataatgtaagaaaagtgattgggattgggtggtgacttaatgaacggtagtggtttttttagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgcgtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattga

SEQ ID NO: 2885 - DNA, 588 bp, Homo sapiens
aacatccagatggaccgggcggggaggtggcctggtggcttcgtgcgcgccgggcgagggaagctggggcgcccactgggctcgggcggcagcttcgcggagagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctgg

SEQ ID NO: 2886 - DNA, 4568 bp, Homo sapiens
agagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctatggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggattagcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatcatgtgaactctcctagactggaatatgaagactgtgattttacagagaaaaggagtttatctccatttcatgaccttttaggatgttgctgtttcaactttaaaagccatattttccttttctcaagtatagctatagaccatatcaccttttaccatgttctgttatgaaaaacaggaagtccctgagctggaatttttcagtctttctctttttcatgtagagagcaaagtttctcttaagggacttttgtttccttcagaattatggtctccttttttctcttccttgccaaaatcactagtttggaagaaatccaacatcatttatttactatggaccacaatgagagtggaactactttgttatcctgccctgatgacttagcattatctcctaggacagaataaaatatactttctctgt

SEQ ID NO: 2887 - DNA, 6781 bp, Homo sapiens
actcaggcgctggctgctgtgtggctcagagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctatggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatgtctggtcgtgctggaagaagaggtcaagacctgcttggaaatgtgtatttctttgatatcccattgcccaaaataaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtatgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagatatcagctctgctattttctaactgaatgactttaagttatgtaatatatctgagctttaacttcatttttggcaaaaccggagtaaaaatgaatacctctagttgttttgaggattaaatgagataatgtaagaaaagtgattgggattgggtggtgacttaatgaacggtagtggtttttttagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgcgtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattga

SEQ ID NO: 2888 - DNA, 428 bp, Homo sapiens
gtccgacgccaggctctgcgctcggtctcctctgctccacctcctccccgcggggcgtgcagctccgaagctctttggacctagcagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagt

SEQ ID NO: 2889 - DNA, 632 bp, Homo sapiens
gtccgacgccaggctctgcgctcggtctcctctgctccacctcctccccgcggggcgtgcagctccgaagctctttggacctagcaggttcggcggccgggtttgctaaagctgccataacaaaatattatagagtggtggcttaaacaacagaaatttatttctcactattctggaggctgtgaagtacaagatcaagattctggctgattgagtttctggtgagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctga

SEQ ID NO: 2890 - DNA, 3793 bp, Homo sapiens
cagtctggggcgagcgctctagtgagcgcggacggatgcttaggcagtagtcctggcagcggcagtagtggtggcagcagaagagaggaagggggagggccccgagggctacacacgctcacactttcaagttcccttggagggagaggaggtggggctgcagaaagaggaggccaggagcggtcccatccgtcccgtcccgtcccgtctccccctcttcctcttgctccttgctccccggctctgcgagagttgagggttcaggtggccgtacgcggcagtgagggcaagagggccgggagagtggggagcggaggcaggagtgcgggggaagatgcccatcctgctgttcctcatagacacgtccgcctctatgaaccagcgcactgacctgggcacctcttatttggacattgccaaaggcgctgtggagttattcttgaagctgcgcgcccgggacccggccagccgtggagacaggtacatgctggtcacctacgacgaacccccgtactgcatcaaggctggttggaaggaaaatcatgcaacattcatgagcgaactaaaaaatcttcaggcttctggactgactactctcggtcaggctctaagatcctcatttgatttgttaaatctcaatagattaatatctggaatagacaattatggacaggggagaaatccattttttttagaaccatctattttaattaccatcacagatggaaacaagttaacaagtactgctggtgttcaagaagagctccatcttcctttgaattcccctctgcctggaagtgaactaaccaaagaaccttttcgttgggatcaaaggttatttgccctggtgttgcgtttgcctggagtggcttctaccgaaccagagcaactagggagcgtaccaactgatgaatctgccatcacacagatgtgtgaagtcacaggaggtcgctcctactgtgtgagaacacaaagaatgttgaatcaatgtttagaatctctagttcaaaaagttcagagtggtgtagttattaattttgaaaaaacaggaccagatccacttcctattggagaagatggacttatggattcatccaggccaagcaattcatttgctgctcagccatggcatagttgtcataaactcatttatgtacgacctaactctaaaactggtgttcctgttggacattggccaattccagaatctttttggccagatcagaatttaccttcactacctccacgaacatctcatcctgttgtgaggttctcctgtgtagattgtgagccaatggtaatagacaaacttccttttgacaaatatgaacttgaaccttcgcccttaactcagtatatcttggaacgaaagtctccccatacctgctggcaggtatttgttactagcagtggaaagtacaatgaacttggatatccatttggttatttaaaagccagtacaactttaacttgtgtaaacctctttgtgatgccttacaactacccagttttacttcctcttttagatgacttgtttaaagttcacaagcttaagccaaatctgaagtggcgacaggcttttgacagctacttaaaaactctgcctccatactacctattaaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacagatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccaaaaagacccagtagcatctactttgggagctatgccaaatacattacaaatcactcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttc

SEQ ID NO: 2891 - DNA, 4858 bp, Homo sapiens
agctgggccaccgcaggctgctccaagtgagaatcgtgagggtggccaagtccagtttggacctctgacccttgggcagcacctcccgacagccggctcgggacccaactctgcgagccaggtgaaaatgagttcttcagtaagaagaaaaggcaagccaggcaaaggaggtggaaaagggtcttctagaggaggaagaggaggcaggagtcacgccagtaaatctcatgggagtggtggcggtggcggtggtggtggtggtggaggtggcggcaacagaaaggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaagcatcagaatctgaggagtcagatgaggatgacggtcctgcacctgttatagtagagaatgaaagctatgtgaaccttaagaaaaagatttccaaaagatatgactggcaggcaaagtcagtacatgctgaaaatggtaaaatctgcaagcagttccgaatgaaacaggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgcgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaa

SEQ ID NO: 2892 - DNA, 1704 bp, Homo sapiens
gagaatcgtgagggtggccaagtccagtttggacctctgacccttgggcagcacctcccgacagccggctcgggacccaactctgcgagccaggtgaaaatgagttcttcagtaagaagaaaaggcaagccaggcaaaggaggtggaaaagggtcttctagaggaggaagaggaggcaggagtcacgccagtaaatctcatgggagtggtggcggtggcggtggtggtggtggtggaggtggcggcaacagaaaggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaagcatcagaatctgaggagtcagatgaggatgacggtcctgcacctgttatagtagagaatgaaagctatgtgaaccttaagaaaaagatttccaaaagatatgactggcaggcaaagtcagtacatgctgaaaatggtaaaatctgcaagcagttccgaatgaaacagatattacaatcacattta

SEQ ID NO: 2893 - DNA, 3486 bp, Homo sapiens
acgagatggctgtgtgcgcaggcgcaagactagcgctcttgggaccggaagttaaggcgttcgcggcgtgtgaatccagggcctgaaaacccagaatgaacttgtgtccatcccagagatcactgcagatgtcatgaggtaccctttgtgtcaccagctcaagcaggcctctggccactttatcatctgtggtggtcctgtgccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccggg

SEQ ID NO: 2894 - DNA, 4372 bp, Homo sapiens
acgagatggctgtgtgcgcaggcgcaagactagcgctcttgggaccggaagttaaggcgttcgcggcgtgtgaatccagggcctgaaaacccagaatgaacttgtgtccatcccagagatcactgcagatgtcatgaggtaccctttgtgtcaccagctcaagcaggcctctggccactttatcatctgtggtggtcctgtgccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccggg

SEQ ID NO: 2895 - DNA, 4548 bp, Homo sapiens
tctcacggccggagttggtggtctgggaacccacgtgggctgggtttcggattgctctgctggtccggccgctggagcgcccaccctggcctagtcgccatggggaagctgcgccggcgctacaacatcaaggggcgccagcaggcgggccccggaccctcgaagggcccccccgagccgccccccgtgcagctggaactggaggacaaggacacgttgaagggagttgatgcaagcaacgcgctcgttctaccggggaagaagaaaaagaagaccaaagcccctcccctgtcgaagaaggagaagaagcctctgaccaagaaggagaagaaagtgctgcagaaaatcttagaacagaaggagaaaaagagccagcgagcagagatgctacagaagctgagtgaagtccaggcttccgaagctgagatgagactcttttataccacttccaagctaggcactgggaaccgcatgtatcacaccaaagagaaggctgacgaggtggtagccccgggccaggagaagatcagtagcctcagcggtgcccaccggaagcgtcgccgctggccctcagctgaggaggaggaggaggaggaggaggagtcggaatcggagctggaggaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccc

SEQ ID NO: 2896 - DNA, 3203 bp, Homo sapiens
atgttgtgagaaagtgctgggctagctgactcggatcatctcctagagtttaggagaaataacaatcacaaagtttgaatttgcaaaacctttaggctttgctggcaggagagaaaataccacttttggatcataaaatggatatggaatacatgggctcaggtaaactgggccaaatattgaagcagatttggagacaaaaccagatgctaaagcaggcactcttgggtgatgacctttgtgagggggctggtggggccacttggatggccactgtggtctttctgggtcaggaactcagcagtgcccttcaccagctgctggagcacacctcaggcaccctgcgttccacctgccagcagctgcatgtgctgcttgacaaagagaatcaatgtgtctcgagaaaaggtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaaaagcctgatctctcttcctttacccctaggaaaaggcacacggtgggtttttgtttctgtcaacattttcctggaagtttccgaatgatattatttgaagtcagtctatttaatgatgtgctatttaatgatgtgagacaaagggagaagcacggatcagataatagaaagcattcctgggtgtgagcgctcctctctggttgagtgattatgttttgcaaccatgactgtcttgagtttggcctcacttaatagcatttgcaattgagtttgacttgttcacattttaaaagctaagtgtgaagaaaagatctgatatatgtaattacttattaattggtatctacataaaattaaactagttttctgtgacttcaagtgtgagcccaaaaatatctgagacagttctcaatcaatttagaaagattattttgccaaggttaaggacaggcccgtaacagcctcagaagatcctgatgacatatgcccaaggtgttcggggtagagcttgcttttatgcattttagggagttataatatatcaatcaatacatgtaaggtgtacattggctcaatctggaaaggtaggacaactcaaagcaggggcttccagatcacaggtagatttaaagattcttgattggcattgattgaacagttattatctaaagacctggaatcaataggaaggaaatgcctgggctatgataagaagttatggagaccaaagttttataatgcagatgaagcctccaggtagcagactttagagggaatagattgtaaatatttctgatcagtcctaaggtctgttgaaatttatgctggccagcttttcctgaattccaaaagagaggagggtattatggagtcatgtccaacctccccttcccagcatggcctaaactagtttttcaggataactttgaaatgcccttggctgagagaaggggcttgttca

SEQ ID NO: 2897 - DNA, 4335 bp, Homo sapiens
ggggagcactgctgcacttctaaagaaagaagaaaaggagatttgtaatttatgcggcatgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtactggggcaagaagagtcacagaataaaatgttcccagataatgcagaaaatgaagatgataaacaaatagaacacatgactgttgagaacataaatggcaacagggaagagactcatggcataattcagacaacagagacagaaattcaagagacttcagaaagcccaagagaagagatgaccacatcctcaataatatgtgatatctccaagaaatatataaatagtactcttcccaatgattcagagaatataaagcacaagaataacataatggaaaaggagtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaaaagcctgatctctcttcctttacccctaggaaaaggcacacggtgggtttttgtttctgtcaacattttcctggaagtttccgaatgatattatttgaagtcagtctatttaatgatgtgctatttaatgatgtgagacaaagggagaagcacggatcagataatagaaagcattcctgggtgtgagcgctcctctctggttgagtgattatgttttgcaaccatgactgtcttgagtttggcctcacttaatagcatttgcaattgagtttgacttgttcacattttaaaagctaagtgtgaagaaaagatctgatatatgtaattacttattaattggtatctacataaaattaaactagttttctgtgacttcaagtgtgagcccaaaaatatctgagacagttctcaatcaatttagaaagattattttgccaaggttaaggacaggcccgtaacagcctcagaagatcctgatgacatatgcccaaggtgttcggggtagagcttgcttttatgcattttagggagttataatatatcaatcaatacatgtaaggtgtacattggctcaatctggaaaggtaggacaactcaaagcaggggcttccagatcacaggtagatttaaagattcttgattggcattgattgaacagttattatctaaagacctggaatcaataggaaggaaatgcctgggctatgataagaagttatggagaccaaagttttataatgcagatgaagcctccaggtagcagactttagagggaatagattgtaaatatttctgatcagtcctaaggtctgttgaaatttatgctggccagcttttcctgaattccaaaagagaggagggtattatggagtcatgtccaacctccccttcccagcatggcctaaactagtttttcaggataactttgaaatgcccttggctgagagaaggggcttgttcagatagttgggagacttagaattttatttttggttgactcaggcaaccaattcaagttacatagataccatagagcctacagtaaacaatacaaaataaattggactgaaagacttgatgtcggtggtagtaactcactttaaaaaaacctttctaagctcgaaataaattaaaaatagaataacacttcagccatttactggcacagacttttcctttataaaaatataacttggaagagggaaaattccatattttgttattagcgaaatgaggcagtgcagagaaaataagttatcagtgaaagaattcaaggcctatttcttctacttaggaagaaaacctgctttaaaattagttaacagaagccttattacataagccctagatatacatcattaaaaataaacaaaacatctgtaaatagaacattaaaatgaaagaaaaaattaaaacttatctaaacccctctttctattgataatcgctattaatgtctagtataagctttgagtttttggaaagcctaacgccctttagctctctgaagcagttggatataaatgggacattgaactagtttcactgactcattaatgcaaaaaccattaggtcgttggcttgaaaacatcggtagcaattagtttcagttattgaatacctaggaattaattgagttatattacaaaattaaatgttttaatctctttcaaatttaaacgcaagacttccttctacaaattaaccagggatttagatatctattcaggtatatatcaaaaaaggcgattcccattttcaaacatagtcccataaaggaatattttattagtcaagattttttacatgctgccaaaaaggtacaatatgtattttcatgtattcttggggcaaagaaaacagactaaaatgttcattgttttcctgattacaatcgaacaaaaaagtaaagaaaatgaaagttgcttctt

SEQ ID NO: 2898 - DNA, 7110 bp, Homo sapiens
agccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacacc

SEQ ID NO: 2899 - DNA, 6864 bp, Homo sapiens
gccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagcccc

SEQ ID NO: 2900 - DNA, 7143 bp, Homo sapiens
agccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagactacaatctggaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacacc

SEQ ID NO: 2901 - DNA, 2956 bp, Homo sapiens
aaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcaactaactatgtcctctcatttttttcccagagattccttcagtcgaatgagccttcgcaaaatggatctctagaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcatttt

SEQ ID NO: 2902 - DNA, 2591 bp, Homo sapiens
gccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccgagccccagctgcacccatcctataccgacagttagacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatgaaaatacaatgtttttatgtatgaaatggctgatttgaaagagtatataaacatagacatactgtgtttgccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgtttt

SEQ ID NO: 2903 - DNA, 4426 bp, Homo sapiens
caaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagcccc

SEQ ID NO: 2904 - DNA, 6337 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagatctgccccctggaggagaagacgagcgtcttaccgaattcccttcacatcttcaacgccatcagtgggactccaacaagcacaatggttcacgggatgaccagctcgtcttcggtcgtgtga

SEQ ID NO: 2905 - DNA, 2514 bp, Homo sapiens
tttgtcttatagtgatgaaataggccagagatttttagtagacttcctctttgtgaagattttctttttctgttaacattgttcttttctggggatatttgagaaattttcagaattacattttatgttaagaagtaaacatgtatgttttctttttaaaagaagcaaatttagaatttttgcattttcctcctattaatattttctatttttcattgaaatgtggtagcacttaaagttctctaatcttaactgttttattttttatcacaacagtaattttatatttgagttttggagtactaaatgcaagtatatacaaggtgtccttataccagcaacgtcttctaccttgacttggattctccctgactttgtcccatgaagatgggcaaacagtaaattctgtcacagaaaggcactgtgctgggctagcttcactttttgcagtgacacctacgtcacaagatggcatttggagaatattgtgccaagtagaataaaatgcctcacagcttaaaacagtgaatgtgagaagctgaagatttctgtcccaacaaaatgttttagaatcgggttttgtgaaatggttaacgtatttttttcagtggatataaatttaacttcttaaaagaaaatcttcctacttcataagcaccctgtatatatttgcatataaaagtgtggactgccttaaaaatagatgggccaaggaaaacaggagtggagatgatgtgactttgctccatgcactgtggaaagatatgctctgctctatacaaaaattgccatggttctctgctgcatgtgaaaaagatcctgaactagactgtgaaccttgtacatgtttgccatccacggtggtcgagtttgatgaacactgtgccttcttattgtcactttgaagtcacccagcagcatgcagtcgatgatagtccatgcatgtccctgttctcctacacacaataacacagtgagggggacggttggctccgggacaggggacaggtgtcattgcagccctggtctcattttcatctgctctggtgatggtacacagcaggaagttagctgtttgattgctaacccaaatcactcttctgttttctctacttgactgctgacaagtttaacaaagtgtgtggctcttctccttcctgcttgggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtcctttaa

SEQ ID NO: 2906 - DNA, 7526 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2907 - DNA, 6304 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagatctgccccctggaggagaagacgagcgtcttaccgaattcccttcacatcttcaacgccatcagtgggactccaacaagcacaatggttcacgggatgaccagctcgtcttcggtcgtgtga

SEQ ID NO: 2908 - DNA, 7502 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2909 - DNA, 7549 bp, Homo sapiens
ctggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2910 - DNA, 7499 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagcttttctttcaccaactgtggagtcaaatgacactcctgtagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2911 - DNA, 3147 bp, Homo sapiens
ttttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2912 - DNA, 7457 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2913 - DNA, 1169 bp, Homo sapiens
cccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcag

SEQ ID NO: 2914 - DNA, 859 bp, Homo sapiens
cgccacacgcacggtcgcccggagcgagcccgggcgctgctgcgatcgcggggggccgcggacgccgaggggggcgccttggggcgtgacacggtgcagagggcgcggcctgggctgcggcggccggactcgcggcgagcagcggggggagcaggcggcggcggcgccgggagcggcgggcggagcgggccgggcgccgagggcgcacctggcggccgcgcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgagg

SEQ ID NO: 2915 - DNA, 7643 bp, Homo sapiens
gtcatgccttcccaccccacaggctctgcagacccagccagcggggctgaccacttgtgcctgggaagccagtttcctttccttccttggaccactggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 2916 - DNA, 4094 bp, Homo sapiens
gtcatgccttcccaccccacaggctctgcagacccagccagcggggctgaccacttgtgcctgggaagccagtttcctttccttccttggaccactggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattggtaacgctccatgctcttgtgggcttctctccaccatcactctgaaagtgtcttggagccaatagttggtgaacgtgtcacacttgtgtggtaggaccttgaagtctaagttgctttcctgagtattcttttcctgcttgtgatagtcaacaactgaaacccctcagccatgccctgaaataaaggtcccggatgcctgtgactcctcaggatcatacagtt

SEQ ID NO: 2917 - DNA, 5592 bp, Homo sapiens
gactgcttgtcacgaagatggtacagtgggagcctgtttcggaagagccaaggaagaggatgtggaaatggagtagagattgctaaaaaactgaacatccacaccttggggatgggttgcactactagtgtgattctgtttaaaggcatccgcaccgtttttgaaagaaactgtgcttatatgtgcaaacagcaaggagagaataatgcccttgaatatacagcatacaattggacaaaagaagattcagaactattgatctcctcctggctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtttaacaaagtgtgtggctcttctccttcctgcttggaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtccttt

SEQ ID NO: 2918 - DNA, 750 bp, Homo sapiens
gctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaac

SEQ ID NO: 2919 - DNA, 348 bp, Homo sapiens
catctgaacttatggatttttttacaatatctgaagtctgcctgcaccagttccagtacatggggaagcgatacatagccaggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctgg

SEQ ID NO: 2920 - DNA, 609 bp, Homo sapiens
aggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaag

SEQ ID NO: 2921 - DNA, 2217 bp, Homo sapiens
ttttttgcgagtggcgggccgactgtgtagtccgctccggcagcgcgctctgcccggcttcctcagtctcctcgccgggagcgtccgggagcagctccgaggccgcggcgaaaccagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtcttaaaaaaaaaaaaaaaa

SEQ ID NO: 2922 - DNA, 1892 bp, Homo sapiens
gggactgggctctgggcggcttttttgcgagtggcgggccgactgtgtagtccgctccggcagcgcgctctgcccggcttcctcagtctcctcgccgggagcgtccgggagcagctccgaggccgcggcgaaaccagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccag

SEQ ID NO: 2923 - DNA, 2567 bp, Homo sapiens
gggctctgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagaggttaggggaaggccggagaatgggctgggaggctgcgtttcggagcttagggttctgtccctgcgatcgccgcgtctccctcccttggtgggcgcggctcccgggaagcggctcgtctcgtctcccctcacaggccgggttcccgttctggaccttcgccctcggaacacagtgctgttggccgggactccttcccgaggtggacggctccctgttcttattcctggctctgccagaactgtaggaagtgctcagtacactttagggcatgcatggcactccctgggagacagtgctttagggccagaggaaagatcttccctgaaggcaaacgcccgcggagcccacaagtccgggccgcactgaacaagtcaggatgttgccatcggcaattctgcagaaggcagtaacccatctgagagaaagagccgctgtcataaggtctcttgcttgagctgctgggttgagaatggagctggaagagggaactgatctcggagctccttggggatcttggttatgtctgacccttttactttcagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcaggtaagaaaggaccagaagttccggttctaccatagcaaggacctaagttgctaatttaggttctttaatgcagacctggtctttcagaacttctttctcttccctagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccagg

SEQ ID NO: 2924 - DNA, 865 bp, Homo sapiens
gtccgctccggcagcgcgctctgcccggcttcctcagtctcctcgccgggagcgtccgggagcagctccgaggccgcggcgaaaccaggtggagtccgaggttcggaggagtatcagagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaaggg

SEQ ID NO: 2925 - DNA, 805 bp, Homo sapiens
cgggccgactgtgtagtccgctccggcagcgcgctctgcccggcttcctcagtctcctcgccgggagcgtccgggagcagctccgaggccgcggcgaaaccagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatc

SEQ ID NO: 2926 - DNA, 856 bp, Homo sapiens
cgctctgcccggcttcctcagtctcctcgccgggagcgtccgggagcagctccgaggccgcggcgaaaccaggtggagtccgagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaa

SEQ ID NO: 2927 - DNA, 863 bp, Homo sapiens
gggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgat

SEQ ID NO: 2928 - DNA, 688 bp, Homo sapiens
gcgagtggcgggccgactgtgtagtccgctccggcagcgcgctctgcccggcttcctcagtctcctcgccgggagcgtccgggagcagctccgaggccgcggcgaaaccaggtggagtccgagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaagga

SEQ ID NO: 2929 - DNA, 941 bp, Homo sapiens
cggcagcgcgctctgcccggcttcctcagtctcctcgccgggagcgtccgggagcagctccgaggccgcggcgaaaccaggtggagtccgaggttcggaggagtatcagagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaa

SEQ ID NO: 2930 - DNA, 129 bp, Homo sapiens
tgcaggagccaaaaatcttgctggatcataaaaggacactgcaggaaaaactgcaaacctggtgaacaggttaaaaagccatgtaaaaatggtgactattgctgcattccaagcaacacagattcttaa

SEQ ID NO: 2931 - DNA, 1970 bp, Homo sapiens
gaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttg

SEQ ID NO: 2932 - DNA, 1324 bp, Homo sapiens
ccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccagacaggaatgagcaggagctgaggaaggtagtgggagaggcccagactgcctcaccactccccaggtttttggaaataatgatgcatgaaggtaaatgccagccacaaggacacagctcgaatgatctggaagcgtgttggagcagcggtggaggggagcagaattctcttccggattggcctcaccaactccatgacctcaggcagctcacctgggctctctgcagctctttcctcctctacaaacaagggaactgaaagcagcagcagccacagcacacaccccagggtgcacccgcggcgccaagaactggtctcagcgctgtctgcggattaacgcatttgtcctcaagcctctgtggagtggccactactgtctattatcacacccatttacagatgagggaactgaggcccagagaggctaagacctcccagccgggcctggccatggggttttgggaatcaggctctcacacactgctggcatggcctttctgaaaatcactatttatcagaagccttggaattcatcctaagaaataaagatagggaaaacaaggttgcttatcacagtgctggtggtaggagatgaagttaataaattatagaacacctgtgcaaaatctgttcagggctgaagactctgctgccaatcatgcctatggaaaaaccctgtgtgcactatatcattaaatgaagataccaagttc

SEQ ID NO: 2933 - DNA, 1162 bp, Homo sapiens
ggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttgaa

SEQ ID NO: 2934 - DNA, 1370 bp, Homo sapiens
gactcccagctggccgagggcgggaagggggcaggcagggaagcggcccgcccttcgtcctgccccttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaa

SEQ ID NO: 2935 - DNA, 1049 bp, Homo sapiens
atgccattcccctgcctcagcctcccgagtagctgggactacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttg

SEQ ID NO: 2936 - DNA, 1175 bp, Homo sapiens
atggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttg

SEQ ID NO: 2937 - DNA, 1244 bp, Homo sapiens
gggcgctcacgcaaccgccactgtctggagcgggctcgcctctgcggcagccctcaccgcccgggctttactgaagcggagtctagcatgtgcggctgctccacagcggtgtgggtggcggcggctcctctgcagcagcctcggcagtaggggtcagggtggccaagcccaccgtggagctcatctgagagttgtaaggtacgggactgcctcggtctttgggacgccccgtctggtagcatcccagatccagcacgttccttccggccctgcaccccggcccggtgcctcacaccccgctaccccaagcatccagactctaaggcagcccctgcatctcagtcctgacatcgctgtccctggagcatcctccgctggagctggagcttgacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctt

SEQ ID NO: 2938 - DNA, 1144 bp, Homo sapiens
gggcgctcacgcaaccgccactgtctggagcgggctcgcctctgcggcagccctcaccgcccgggctttactgaagcggagtctagcatgtgcggctgctccacagcggtgtgggtggcggcggctcctctgcagcagcctcggcagtaggggtcagggtggccaagcccaccgtggagctcatctgagagttgtaaggtacgggactgcctcggtctttgggacgccccgtctggtagcatcccagatccagcacgttccttccggccctgcaccccggcccggtgcctcacaccccgctaccccaagcatccagactctaaggcagcccctgcatctcagtcctgacatcgctgtccctggagcatcctccgctggagctggagcttgacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttg

SEQ ID NO: 2939 - DNA, 1321 bp, Homo sapiens
atgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagctctggatggacaaggaaaaagaggaaagcatgaaagaaaccctgcggataagaaggtaaactgtcatgagggcaagggcactaagagacatgaagatgggaaggtctggtccctagcagcccacagcccgctgtctcagtcccacagataacacaggcaggctctcttctgcctcacagaccacgaattcataaacactatcactacagtgacctgagcaagaagtcagcttccctttccaaaggtaaacacagagacatcggggtttcagcagtgcagaggtctcggagaagccctgagtcctctctccacctgggggattgcctccacctctgagcatccatggagaccagggaccataaccaaaaccatgctttgttagtccccttgaataatgacacatgtttacaaaactcaggttgatgatctacaatccaaatgaaaagaatgaagagttttactaagccccaaactccccttgcctaaggagttactttcttccccagtgagctgggtgaactgttcaagcacctttgtcgggctccctttcctctaagttccctgcctctctctaccttctggcttcaaggacaaatgccagtaatgcctaactctgtactcgtccagacatcccaaatcttcccaaagccattctgatgtgagacatgagctgcaggcctggttcataactcattaataagtgaggggattgtcaacctagagcaccaatgaatgatctagcccatgtagctcaatactggattcacattagaatcacctggggagctttttaaactgcaggtgctcaggccccacccactcccagagattctttttaattggtccaaggtaggacttgaccatctgggcttttgtttttctttgtcttttcttttcttttcttttttggtt

SEQ ID NO: 2940 - DNA, 2571 bp, Homo sapiens
gcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtacaaaagttccaagagagatgctctcttttcaggggctgcaatgtcctctctgagacctagtggtggatgaggtctcctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccatcacgagggttcttatcagagacaggtagagggagatttgagtacagaagacaagatattcgtgtgatgatgcagacagagactggagtgatgccaccacaagccaagcaatgcctggagccaccaggagctgggacaggcaggaaggattctcccttatacccctcagagcaatcttggcccctctgacgtcttgactttagacttctggtccccagaacggagagagaataaatctttcttgttttaaggctccaacaaattggtagtcacttgttacagcaaccacaggaaatgtatacagcttctgatacttctgaaaacctcacacagccaaagggtacatccttggtatagaggctcactcttactcaccagccaggcaaggaaggctcaatcctttggtgttagagagatagatgttgggttttcaaatttcaacatagagaaatcagtcatttgcaatgcttttgagaaagtactgtgtataccctacgagcctgcactccttatgtgtgagactgatgaccattggttggcttattatccattccactaagtgacaaaatcccactgactattcaaatccaggctcctggcatgcctgtaccttagaatcacaaccagctgcaattccaggatggagttcaaactaattgtgggggcatgtgcttcttacatgactgctagattgttcccagatggggaaggttgccctgataagcaacttaaatgaaaataataaatgtattgtttggcctcttt

SEQ ID NO: 2941 - DNA, 558 bp, Homo sapiens
attttcgagtgatacctgatctcatcaatctagcggaagagacaggataacctatccaagagtatagcgccactatgactccgccggaaaaattactttaaaaatcgccaaaaattacttggagcaaagggcagtaggcggagcttcgccaaggctggcgcagtcggtttaataatgatagaatgaagaccataataaaagagacctctacttacctcagcaattcttacctttcttacctatttgatgaagatgtcttttgaaaggtgtactgcaaggaacaaaatgtttgtaaattctgcttttaccaaggtggataattactgtaccttcctcatggaaaaagttttatttaaagtgttatttctcgttgaatactatcaaaaaggaaaaaaaaatgacctaaacttttgagacagatttggctctagtaagtatttagatatatcgcttgcatatctgggagaagaaataagagactatcatcaatacattcccatctactaaaaaattttattttacacatgtcaagggattacttataacttccattgtctt

SEQ ID NO: 2942 - DNA, 1162 bp, Homo sapiens
gccattttcgagtgatacctgatctcatcaatctagcggaagagacaggataacctatccaagagtatagcgccactatgactccgccggaaaaattactttaaaaatcgccaaaaattacttggagcaaagggcagtaggcggagcttcgccaaggctggcgcagtcggttttgacctgtagcagagaaccaattctggagaacagcctcacttctttgattgaatactcacataatgctttggaacaggacatgagattaaggtttaataatgatagaatgaagaccataataaaagagacctctacttacctcagcaattcttacctttcttacctatttgatgaagatgtcttttgaaaggtgtactgcaaggaacaaaatgtttgtaaattctgcttttaccaaggtggataattactgtaccttcctcatggaaaaagttttatttaaagtgttatttctcgttgaatactatcaaaaaggaaaaaaaaatgacctaaacttttgagacagatttggctctagtaagtatttagatatatcgcttgcatatctgggagaagaaataagagactatcatcaatacattcccatctactaaaaaattttattttacacatgtcaagggattacttataacttccattgtcttttttttaagcctatatgcaatgaaaaatatattggcaaaataaatatttaaaccttttatgttaaaattactgtgaaagatgacaagttagctgctgtttttgtctacattatactgaaattaaatgtttataatttatattttgggtttatttatttataaatcatggaatttatgcaaaaaacatgagtagtacagattctcctctaattctgtaggactttgaataatgtgatatttttcttatagttggacccttgtgttttgaagaaatgccaactgcttgaagaatttccttgttatttgtattatttgctatagggttagatgttgagaaattcttctgacaaaaaattttaagccagttttacactaaatattccttagtctgattaatttgttattggatgtattctgtatctttcttttgtaatttgtaacttttatccacttagcacgaatgattctattgaagaaaatctttaggaagtggtagaaactttaaa

SEQ ID NO: 2943 - DNA, 2092 bp, Homo sapiens
ctggagagagggaagaagcaacgctcagcatttcgctgattttcaagtgcacaccgagcagcgcttcaggcagctttgggtcagaacacgcctgattcggacttcaggcgaaggcagaggccagcacgggtcaccgattcagagccgggggcggggccgaccacacacgctgtgagacccagaggccgaggagccgcgggttagaaaatgtgaccttggcgaccccaacgcccccgcctccctcgctgctgctccacctgcacgcggagcgcgccgggccgccagcggaggcgatggccagccctgcgcccttagtggcctccatcagccaccaaatggtggctctgcagaccttgcagctgctgcagcaggagtggggctggggggacggtccagtcgcccccgggaacccgcgggacccagaccacgtgtccaccgctccagcccgtcgctcaggcccgccgcgggcccggccggggcccgggcgcgaggagcggggcgggggcgtggggaccaggagtcggcggaccgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaagcttcaactcctggctaatgagtgaagaaggtcactgtaggagtgtgaggaccatcaggagcttcatatttcaataaccagtgccaaattctgaatgccagatgggatgagatgggatgttaaaccacttcttattaccacgttgttggcctccattgccttcgtattggtctccaattgcatggtctctgtggatctctgacttcttattacctccgattggaacgcgccacaaatcatcctgctttctttatcctctctcacctccaagtaatcctgtcatcttgctccaattagagccgcttccattaagaagatcgtgacaaattccctacccctgtttgctcttcaggaaaattatcccctggaaaagtggatgttatagtcgcttttcagaatgtattgtctgaatttcttgtcttccaacattctcctaagccagttacctttgcactgaagtagaattcaaaaggagatagaggttctgaatttcttcctttgaccagatggaagtcgttacatcagaatgctgatgactgcaaaatcttggacatattgttttcacaattaggaaatggcaaacacaaagttcttcagtgcaaagccagcatgcgagttcagcttccatttgctgctataaattttgttcttgttgctgccagtaaacaccaactgttcaagtgaaatagtaaatccaaatgtgcctgttggatgagagtaaaaaaattatatgctgcataaatgctgatgcaaaaggatttttcaacacactaaaccagggtagggaaaggaaccgagaaagaaagttgaactgaatgcagctctcactaacaacttcttggtaaaagcactaaaaaagctcttgatagaatgttgattcaacatactgtttaaacctcaaggaaaaaaacaaacgcagaattgggatattggccttaggatatctgcttaaagtcctactttgagctctcatcagggttaccaaagaaggcgtacatagattgttacaaatcaaagcaaagaaaaatcccaaagttccctcaaaactgatgtgggcacttggcccagaagttgtttgctaatgatcagtctaacagctgaaagtcaaagtcagtggctagtaccatctgcaataggatttaggaagttttgatctcacaaatttactgtaaggctaatcaatgaatgtttgtactcaggtctccctacagttaaatttaatgtgtaactggaattacgattcaaagagatagtttcataaatggtccctgaaatttaattttggattacctaagtttacaatggatttctcttctcctttccccaatatttttcttacgc

SEQ ID NO: 2944 - DNA, 883 bp, Homo sapiens
aagtgcacaccgagcagcgcttcaggcagctttgggtcagaacacgcctgattcggacttcaggcgaaggcagaggccagcacgggtcaccgattcagagccgggggcggggccgaccacacacgctgtgagacccagaggccgaggagccgcgggttagaaaatgtgaccttggcgaccccaacgcccccgcctccctcgctgctgctccacctgcacgcggagcgcgccgggccgccagcggaggcgatggccagccctgcgcccttagtggcctccatcagccaccaaatggtggctctgcagaccttgcagctgctgcagcaggagtggggctggggggacgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaaggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatgagtgttaaaggcatcgggagtaaaaccacagccagcactgttaagagaaccagataccttaccttcctaattgagtcagcagacaatggatatttttatatccaaagggg

SEQ ID NO: 2945 - DNA, 1122 bp, Homo sapiens
cgctgctgctccacctgcacgcggagcgcgccgggccgccagcggaggcgatggccagccctgcgcccttagtggcctccatcagccaccaaatggtggctctgcagaccttgcagctgctgcagcaggagtggggctggggggacggtccagtcgcccccgggaacccgcgggacccagaccacgtgtccaccgctccagcccgtcgctcaggcccgccgcgggcccggccggggcccgggcgcgaggagcggggcgggggcgtggggaccaggagtcggcggaccgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaaggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatgagtgttaaaggcatcgggagtaaaaccacagccagcactgttaagagaaccagataccttaccttcctaattgagtcagcagacaatggatatttttatatccaaaggggaaagacttgatggtacgtggagcagtctgaccagtggcatctgtagccttcgggattatagcatgttaatgaaatttttttaaagcagtagttcatatttttaagtatattgacctatttgctgactttctgattgaaatacattctactttgtgaagctgatttgattatgtatgtatatatttattcatattattagtttttattgaatgataccttaatttgtattcatattaatgtaggtctaaagggtttaatgtggttatttatataattaaagttccatggttcttaaaa

SEQ ID NO: 2946 - DNA, 641 bp, Homo sapiens
agcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagcggactggttggaggcttctctggacccctctggccatgcggtgtgcaggtgtgcatggcaccccctctgagatagacaccagctacctctggatgacgccttgctgagctttgcccacgccaactgcaccctgatcatctcttaccagaagccaaaggaggttgtggtggccgagtctgagctacagaaggaactaaagaaggtgaagacagcccacagcaac

SEQ ID NO: 2947 - DNA, 518 bp, Homo sapiens
gaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagcggactggttggaggcttctctggacccctctggccatgcggtgtgcaggtgtgcatggcaccccctctgagatagacaccagctacctctggatgacgccttgctga

SEQ ID NO: 2948 - DNA, 695 bp, Homo sapiens
gaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaataccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagtt

SEQ ID NO: 2949 - DNA, 858 bp, Homo sapiens
ggaacggttgccatggcagcggctgggcgtgctgcttagcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagtactacaagaagttctccattcctgatctagatagacaccagctacctctggatgacgccttgctgagctttgcccacgccaactgcaccctgatcatctcttaccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagttacttactgcacaggga

SEQ ID NO: 2950 - DNA, 1499 bp, Homo sapiens
atctgcagcccgaatttattcttcgcagggaggtagagaggggacatctccttgcagaccgcccctccgcttggtggtcctgaggctcccgtgggcacaaggactggaacttctgaggttctccctctgagggggcccccagacctgtgctgccctctgtcaacctgctcacccagagatggagcttataccttcctgccgaagactgtcaaggaggcggctgaagataccccggtgggaccggccatctgggaatctttgcaagtacttttgatgatgcatcagcatgaattttctgccgcttgggaaatgccttcaagatacccctgggatccattgaagtatggctggatcccggcctattggagcgttggtcagggctgctgcacgtggaaatccagaattgaggccctccaacccctttgcctatggagactcgcagaggaaggaggaggactttcgggggtgagtgggaacgccctgcacctgtcctggtctcagcctctcgacatgggggtgctcagcgccgcagctgcggggagatggggcacggccgcagcaggtgtggggagccctccgggaatggaggagtctcgcagctgcgggtgaagtcccgggcaggtgcggtgtactcgccgtgtacgcagctggcgcaggccagggaatcccagctcggggctagaagaaagctggagtgcccgaccccggccccaagagtctctccaacccccagagtcggtccccgggtggggtcgactactggccaagctagtcacccgggggtgggcaggaatagaccacttaccagcagagccaatgagagcggacgaaggggggaaggagggcaaatggccagaatagcttccgagtcagccggaagtgaccctctggaacggttgccatggcagcggctgggcgtgctgcttagcaggggaaagatggcggtgacgggctggttggagagtctgcggacagcccagaagactgcgctgctgcaggacggtaactcgagggtccccacgggctccttcgtttttttccctcagggtccggccctccgggaagggcctcagggcctgggtcggcagagctggaagggtctcggcggtcagccgggccaggtcctgcatttgcagatgaggagactgaggttcacagagatgacatgactggaacacatgtctccggacaccccttagattcctctacaccatctcgctccgctctgatttctgttgctaatatagtaatttcttttacattcattatctcatttgctcctcaccactgtcctgagaggctaattttcaccccgttttacagaagaggaaactgaaatccaagaatgttttagactttagagaggagagaggcctgggctctagttccgactgtgccattaattcaccacgggcgcttcagtcggctcctttacttgtttgggcctcactttcctcatctataaaatgaagtggatggactaccattgttatctctga

SEQ ID NO: 2951 - DNA, 369 bp, Homo sapiens
gctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaataccagaagccaaaggaggttgtggtggccgagtctgagctacagaaggaactaaagaaggtgaagacagccc

SEQ ID NO: 2952 - DNA, 3735 bp, Homo sapiens
gccgcgggcgagcctgcgctgggccggccgagggaagcgcgccgctggggccgggggcggcggggaccccacgggagcgcgcgcggcggggacccccaggggcttgcgggcggccgggggaggctcggcggacaaaggggcggagggcggagggccatggcgtccccggcacccgccgccgcccgcccccgagccgcgccgccagccgtcccggcccgccccggagcccccaagatgcgccccagagcccgcggagccgccgcccgcggggagggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatg

SEQ ID NO: 2953 - DNA, 542 bp, Homo sapiens
actcccaggactgagcccggacgccgccgtctcgcgcctcggggacctgcagaaagccggtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctac

SEQ ID NO: 2954 - DNA, 537 bp, Homo sapiens
agtgttggcgtatgctttgtacacctgggccacgcagcctgagcccacaggttcccggttctcaaaagagaggatgctcccccagtcatccccaaaagcctgccgaaggaagcgctcagtggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactca

SEQ ID NO: 2955 - DNA, 800 bp, Homo sapiens
cagacccgccttccccgcagcccacggcatttccctgcggacttctgctgtgcagcctgtgttccttgacggtgtcctgcgtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctc

SEQ ID NO: 2956 - DNA, 3614 bp, Homo sapiens
gtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcaggtacccgccttggctacttctgctaaagcgtttgaatgacagtcgctcttggaccctctagtctgtagagcaggtgaccgcctagcattgaagagtaagcccttctgagataaggatggaataggctgggcgcggtgactcacacctgtaatctcagcactttgagaggctgaggtgggtggatcacttgagaccaggagttcgaggccagcctgtgcaacatggtgaaactccgtctctactaaaaatagaaaaattagccagccatggtggcccacgcttgttatcccagctacttgggaggctgaggcacgggaatcgattgaacctgggaggtggacattgcagtgagctgagatctcaccactgcactccagcttgggcaacagagggagaccttccctcctgcccccacaaataaaggatggccaggcacggtggctcatgcctgtaatcctagcacttcgggaggccgaggcaggcggatcacctgaggtcaggagttcaagaccagcctggccaacatgatgaaactcagtctctactaaagatacaaaaatcagccagtcatggtggctcgtgcttgtaacaccagctacttgagaggctgaggtacaagaatcgcttgaacccaggaggcagaggctgcagtgagctgagatcgcaccattgcactccagcctgagcaacagaatgacattccatctcaaaaataaaaataaaataggccaggcgcagtggctcacacttgtaatcccagcactttgggaggccgaggcgggtggatcacaaggtcaagagattgagaccatcctggccaacatggtgaaactccgtctctgctaaaaatacaaaaattagctgggcatggtggcgtgtgcctgtagtcccagctactcaagaggctgaggcaggagaattgcttgaacccaggaggcagaggttgcagtgagccgagatcatgccactgcactccagcctggtgacagagcgagactccatctcaaaaaataaaaaataaaataaaataaaggatggaa

SEQ ID NO: 2957 - DNA, 3562 bp, Homo sapiens
aagatgcgccccagagcccgcggagccgccgcccgcggggaggtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtgg

SEQ ID NO: 2958 - DNA, 3452 bp, Homo sapiens
ggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagt

SEQ ID NO: 2959 - DNA, 4728 bp, Homo sapiens
aacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaaggcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaacccccc

SEQ ID NO: 2960 - DNA, 6163 bp, Homo sapiens
tgatacccgggagactagcttggccacaggagacaacgttgaggtacagacaggtggcagagaaacaaacatcggtattgcttaaaccacttgctatttccagttccggctgtatgtaccaaaacttaatcttatatagtaccccaaagaggtgctatgaaaattaattgtgatagtgtgattgaagtgattggcacatagtatttaacaaaatatttaatgaagtgtaatcactgttcttgctgttttaattctcacaatactctgtatgaagtgggtgttcaataagtatttgatgaatctttaaaaatttgctaggtctaccataaccaaataccgcagattgagtggttcaaacgccagagattgatattctcacaagtctggaggctgtagaaatctaacatcaaggtgccaacagggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaaggcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctctactaaaaatacacacaaaaaattagctgggtgtggtggcaggtgcctgtaatcctggctgctcgggaggctgagccatgagaatcgcttgagcccaggaggcagaggttgcagtgagccgagatcgcgccactgcattccagccagggtgacagagcgagactccatctcaaaaaaaagaaaaaaggaaaagaaaaaagaaaaaaacaaattcaaagaagttaaatacgttgcccaaagttgtacaacacagaactgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagacctttaatatctaaagtagtagtagtagtgattggaaagagaaagttttcagtgatggtgcagtgttttttttgtgtgtgtatgtgtgtgtgtgtgtgttttgtttcggttttttttttttttttttgagatggagtttcgctctttttgcccaggctggagtgcaatggtgtgatctcggctcactgcaacctccgcctcccggcttcaagcaattctcctgcctcagcctcctgagtagctggaattataggcacccgccaccacacctggctaattttgtacttttagtggagacgggggtttcaccatgttggccaggctggtctcgaactcctgacctcaggtgatccacccaccttggcctcccaaagtgctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccaca

SEQ ID NO: 2961 - DNA, 5701 bp, Homo sapiens
ggggctagggggtggggctgcagccgggacggggccttcggcagggcctgcgggggcgggacggagcggacccgagtgatacccgggagactagcttggccacaggagacaacgttgaggtacagacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctctactaaaaatacacacaaaaaattagctgggtgtggtggcaggtgcctgtaatcctggctgctcgggaggctgagccatgagaatcgcttgagcccaggaggcagaggttgcagtgagccgagatcgcgccactgcattccagccagggtgacagagcgagactccatctcaaaaaaaagaaaaaaggaaaagaaaaaagaaaaaaacaaattcaaagaagttaaatacgttgcccaaagttgtacaacacagaactgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagacctttaatatctaaagtagtagtagtagtgattggaaagagaaagttttcagtgatggtgcagtgttttttttgtgtgtgtatgtgtgtgtgtgtgtgttttgtttcggttttttttttttttttttgagatggagtttcgctctttttgcccaggctggagtgcaatggtgtgatctcggctcactgcaacctccgcctcccggcttcaagcaattctcctgcctcagcctcctgagtagctggaattataggcacccgccaccacacctggctaattttgtacttttagtggagacgggggtttcaccatgttggccaggctggtctcgaactcctgacctcaggtgatccacccaccttggcctcccaaagtgctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccacaga

SEQ ID NO: 2962 - DNA, 2784 bp, Homo sapiens
ggggctagggggtggggctgcagccgggacggggccttcggcagggcctgcgggggcgggacggagcggacccgagtgatacccgggagactagcttggccacaggagacaacgttgaggtacagacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaaggcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacactccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggttacaaaatgaaatttctgcaaaagaaatga

SEQ ID NO: 2963 - DNA, 2077 bp, Homo sapiens
gactctgttggtgctggcttctgctgccttcctgggtcccgtcacatccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatggaaggacaagtggtaggccgggtgttcaggctcttccaacgccgactgcttcaactccgagcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 2964 - DNA, 1894 bp, Homo sapiens
ataggggggcggggccagcgcggagctgggagcgggagccgggcactccaggggccatggatgggctcggccgccgccttcgagccagcctgagactgaagcgcggccatgggggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 2965 - DNA, 5438 bp, Homo sapiens
ggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggttt

SEQ ID NO: 2966 - DNA, 5282 bp, Homo sapiens
ggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggttt

SEQ ID NO: 2967 - DNA, 5706 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttc

SEQ ID NO: 2968 - DNA, 2402 bp, Homo sapiens
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaaggagtttccttctacacagcaattacatcagataagacagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaatcgataactggcttaatgcagcaattgaatgcttggagtatttccctgaccagttaatagttacagttagtcagcagttaatgcaaaacagaaatgaagagacaagattgaacagtcagaagaagatactctttgatgtcatagcaaaatactatgctcaagagagagattgcctattaactgatgagtattttgatattcattcaggaattattgaacttttagaaaatgagaaaagagcagaagcacttgaagcaacacaactatatctaagattgctgttgctgaacattagagaagaattacgacggctacttacttttatggcaatggcatcagagcccaatgcctacaagttgcaaaaacagtatgataataaaacagtggtcctgaaaactcttgccaaatcagttttgcaagccaaatcattattaaaagtgcgggcagaacaactggtctggtttccactggagtaccactctgagctcttcaaggtatggctgaaaataacagctacacatctacagcttaggatactggagatttaatgagaaaaagtaccaaaaggttgacacatggctttacgttttgccaacccttgacatacaaggagtttgaaaagcagaagggaaggacaattcagtatctacaccagttggctcttgagattaatagtaaccccagcatctctctgaaacgaaaaaagaaattaattaaggaatttcaaaaacaccatccagaagctttgaattaacatttctgatacaagaaactacaatttttggggaggaagttagtatacttccagtggaagacctgagagggtacctgaagagataccgggaaaatattggaaacatgccaccaagccctcttcgatagaagtctccttatttggaaagttgccattttaatgttcagtgtgaatcagagacggggtcaaacactgttgcccaggctggagtgcagtgacgcaatcctaactgactgtaacctcaaactcctggactcaagccatctccctaccttggccacccaaagtggtagaattacagaggaaggctgaggcaggaggattgcttaaacgcaggagtctgcagctgcaatgaactgtgatcccactactgcattccagcctgggtggacagaacaaggccctgtctctattttaaaataataataacacaaaaatgcccctcccccatttttttttaaagttcagtatgtaacaagttctatactggatcctttctttctctaataatcctcaagaaatccttacaggtaagtattgcttccgccactgcagaggcgaaagccagtgctttggtaaaggtcctagtctttctggctttaacacagaaagtcttaataccatttggattaaagattcacaagttaggccgggcgcggtggctcatgcctgtaatcccagcactttgggaggccgagacaggcagatcacgaggtcaggagatcgagaccatcctggctaacacggtgaaaccctgtctctactaaaaatacaaaaaactagccagcctggtggcgggcgcctgtagtcccagctacttggaaggctgaggcaggagaatggcgtgaacccgggaggcagagcttgcagtgagccaagatcacgccactgcattccagcctggacgacagagcgagactccgtctc

SEQ ID NO: 2969 - DNA, 1155 bp, Homo sapiens
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacaggtgaaaaattttgcaataagttttgccatttttttttgctatttttttcctctaaaaaccatttatgctaatgttaatctttctgtttacagtatgataataaaacagtggtcctgaaaactcttgccaaa

SEQ ID NO: 2970 - DNA, 2564 bp, Homo sapiens
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaatcgataactggcttaatgcagcaattgaatgcttggagtatttccctgaccagttaatagttacagttagtcagcagttaatgcaaaacagaaatgaagagacaagattgaacagtcagaagaagatactctttgatgtcatagcaaaatactatgctcaagagagagattgcctattaactgatgagtattttgatattcattcaggaattattgaacttttagaaaatgagaaaagagcagaagcacttgaagcaacacaactatatctaagattgctgttgctgaacattagagaagaattacgacggctacttacttttatggcaatggcatcagagcccaatgcctacaagttgcaaaaacagtatgataataaaacagtggtcctgaaaactcttgccaaatcagttttgcaagccaaatcattattaaaagtgcgggcagaacaactggtctggtttccactggagtaccactctgagctcttcaaggtatggctgaaaataacagctacacatctacagcttaggatactggagatttaatgagaaaaagtaccaaaaggttgacacatggctttacgttttgccaacccttgacatacaaggagtttgaaaagcagaagggaaggacaattcagtatctacaccagttggctcttgagattaatagtaaccccagcatctctctgaaacgaaaaaagaaattaattaaggaatttcaaaaacaccatccagaagctttgaattaacatttctgatacaagaaactacaatttttggggaggaagttagtatacttccagtggaagacctgagagggtacctgaagagataccgggaaaatattggaaacatgccaccaagccctcttcgatagaagtctccttatttggaaagttgccattttaatgttcagtgtgaatcagagacggggtcaaacactgttgcccaggctggagtgcagtgacgcaatcctaactgactgtaacctcaaactcctggactcaagccatctccctaccttggccacccaaagtggtagaattacagaggaaggctgaggcaggaggattgcttaaacgcaggagtctgcagctgcaatgaactgtgatcccactactgcattccagcctgggtggacagaacaaggccctgtctctattttaaaataataataacacaaaaatgcccctcccccatttttttttaaagttcagtatgtaacaagttctatactggatcctttctttctctaataatcctcaagaaatccttacaggtaagtattgcttccgccactgcagaggcgaaagccagtgctttggtaaaggtcctagtctttctggctttaacacagaaagtcttaataccatttggattaaagattcacaagttaggccgggcgcggtggctcatgcctgtaatcccagcactttgggaggccgagacaggcagatcacgaggtcaggagatcgagaccatcctggctaacacggtgaaaccctgtctctactaaaaatacaaaaaactagccagcctggtggcgggcgcctgtagtcccagctacttggaaggctgaggcaggagaatggcgtgaacccgggaggcagagcttgcagtgagccaagatcacgccactgcattccagcctggacgacagagcgagactccgtctc

SEQ ID NO: 2971 - DNA, 4065 bp, Homo sapiens
ggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccaggcctcactcagcgtgcacgcacgttggggagaagtcggcccttgggatctttctcttgagtcattttatttttatcatggactagtgcgtgctccgtgtccaccccaataaaagggtctttcctacttgacctcgcgtctttgctccacacaccttggctgcagaggacggagcccctgggagtcatccctgttgtcaccaagaggagtgagaagggccccccacgccaggggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctctgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgaaccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctccccctagaacccctgggtctgtcgggacatgccccacctggcacacacaccctgtgtagctcccactgcctgtgggaggacgctgggcccctgagccggcctctgtctacccctcctgcctttggggtcccctttaccccactgttcccccaaactgccttccaccttctccgcctttgcacaggctgttctcctgcctccagtgaactctgacttctccacagcctcccaaagggccccttgctcacactggcccagccctgcagcatggccatgttggtctctgagccttaagcctttggatgtggacacatttgtcctcttcctgaaaaatgtgagggtctgagaggccacgttcctgttcctgagtcatacgacagagtcccagtgacttgggtctgatgtctgtcccacagtgggacatccctgctgcatcccaatgccaccccgtgtcctggggacacccaaatgtgccattctctcagtatcacaagtcggggactgcaggaggctcaggtgccaggtgccttctgatgttcatgccacaagctcttcccactgtctctggctccccagacgatgttccaggaggcgggtgtgccagaaggggccacgtcttgcaaaccaccgcgctgtcctctttgagaaggagtcttactcaggactggggcctgtgcacacattgtcgcctcttttcagcacttagagattccttcctttgtctagtggctgaagccagggctgaagttggcctccaaatctgggccgtctcagaggcggcgcagcctggagttttccatctgtggccaagacccagtttttgggaggaggccctcatgggtcaagccagcctgtaccaggatggggggagggggttcccaacctaggccccagccacccagactcccccacccccactcccttttccactgctctgacctcgggcactgttgaaatatagtttttattgcatttctgccgttttacaaaaatatgacaaaataaatt

SEQ ID NO: 2972 - DNA, 1149 bp, Homo sapiens
atgatgttccccggcctcctcgcgccccccgccgggtaccctagcctcctgcggcccacgcccaccttgacgctgccccagtccttgcagtcggcattttccggccactccagcttcctggtggaggatctgatccgcatcagccgaccccccgcctacctgccccgcagcgtgcccaccgccagcatgtcgccgcccaggcagggggcccccacggccctcaccgacacgggggcctcggacctgggctccccgggtcccggcagccgacggggcggctctccgccgactgccttctcccctgccagcgagacgacgtttctgaagtttggagtgaacgccatcctctcctcggggcccagaacagaaacatccccagccttgctccagagcgtccctcccaagaccttcgcctttccctacttcgaagggtcttttcagcctttcatcagatcttcttatttcccagcttcctccagcgtggtgcccatccccgggaccttctcctggccgctggccgcgcgcgggaagcctcggcggggcatgctgcgtcgagcagtcttctccgacgtgcagcggaaggcgctggagaagatgttccagaagcagaagtacatcagcaagcccgaccgcaagaagctggcggccaagctgggcctgaaagactcgcaggacacagcccgaaggacagagcctgcacccgactccactccccgcccccgtgcgtcccccggagcccctgatctgacctctgcttctcccttcttctcgccggccgggacattccaggtgaaaatctggttccagaaccgacgcatgaaatggcggaactccaaggagcgcgaactcctgtctagcgggggctgtcgcgagcagaccctgcccaccaagctcaatccgcacccggacctcagcgacgtgggccagaagggccctgggaacgaagaggaggaggagggcccgggcagccccagccaccgcctggcctaccacgcgtcctccgacccccagcacctgcgggacccgcggctgccagggccgctgcccccctcgcccgcgcactcgagcagtcccgggaaaccttcggacttctcagattccgaggaggaagaggagggcgaggaacaggaggaaatcaccgtgtcctag

SEQ ID NO: 2973 - DNA, 1380 bp, Homo sapiens
caatcagagagtccagagcctccggcgaatgaagctcgagtggagaactttgttgaacttcattgtcagagctgtcacttttcaaagtgctttagcgggcgggccactataaaaccatcacctcgacgagaggaccacggaggactcgcagacgcccaagtgggattgttacttggagacgtttgctaagcccaagagagaggacactgtgggggcgggaggggcgggaagcgaggcgtttaccctccggccactgaaagaagggttatttcgcccgcccgcgcctaccatgatgttccccggcctcctcgcgccccccgccgggtaccctagcctcctgcggcccacgcccaccttgacgctgccccagtccttgcagtcggcattttccggccactccagcttcctggtggaggatctgatccgcatcagccgaccccccgcctacctgccccgcagcgtgcccaccgccagcatgtcgccgcccaggcagggggcccccacggccctcaccgacacgggggcctcggacctgggctccccgggtcccggcagccgacggggcggctctccgccgactgccttctcccctgccagcgagacgacgtttctgaagtttggagtgaacgccatcctctcctcggggcccagaacagaaacatccccagccttgctccagagcgtccctcccaagaccttcgcctttccctacttcgaagggtcttttcagcctttcatcagatcttcttatttcccagcttcctccagcgtggtgcccatccccgggaccttctcctggccgctggccgcgcgcgggaagcctcggcggggcatgctgcgtcgagcagtcttctccgacgtgcagcggaaggcgctggagaagatgttccagaagcagaagtacatcagcaagcccgaccgcaagaagctggcggccaagctgggcctgaaagactcgcaggtgaaaatctggttccagaaccgacgcatgaaatggcggaactccaaggagcgcgaactcctgtctagcgggggctgtcgcgagcagaccctgcccaccaagctcaatccgcacccggacctcagcgacgtgggccagaagggccctgggaacgaagaggaggaggagggcccgggcagccccagccaccgcctggcctaccacgcgtcctccgacccccagcacctgcgggacccgcggctgccagggccgctgcccccctcgcccgcgcactcgagcagtcccgggaaaccttcggacttctcagattccgaggaggaagaggagggcgaggaacaggaggaaatcaccgtgtcctagaagccgctcgcacgccagagtactatttttaagtgctttgaaatcgaagaggtggggtc

SEQ ID NO: 2974 - DNA, 1561 bp, Homo sapiens
ccgggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaa

SEQ ID NO: 2975 - DNA, 3920 bp, Homo sapiens
ggcttagggactcaggctgcccagacctgaagcggtgtgcggccatggaccgcggagctgccgcagcccagggcactgccccgcctcaggatggagagcagcccgctgagtctccagagcctccgccgccttggccgccgccgccaccaccaccggctccgccgccggctccgccgctgctctccgaggcttcgccagaacccataccagagccctgtccagagcttgctccaggtccctgtccagaggcgacctcagaatcagccacagaactgtacacagaaccgaccccagaaccagccacagagccggcctcagaaccggccccagaacctgccacagagccggccccagaacctgccacagagccggccccagaaccggccccagaacctgccacagagtctgccccagagccgactccagaacctgccctagagtcggtcccagagccggccccagagctgactccagaagttgccccagagctggccccagagccgaccccagaacctgtgacagagctggccccagagttctgccctgaggcggctccagagttccgtccaagtccagcaccatgtctattgcaatgtccggtggacactcgagagagaggtctaaagacctcgccatcgccatcgccatcgccatcgcccagaacgccaatgtcgtggtccagaataaagaaaatattgaaggaaggacctatgctgaagaactgtaactctttcaagagatggaagcttagatattttctggttcaaggacagaagctctactttgcacaccatcccgcgtttgcacactttgaaacgattgatctgtctcaagccactgtggcagaaagcagctgtagaaacctttgccacagtttttgtgttattacaccacaacgaaaaatcactctggctgcacccaaccggaaagacatggaagaatggattaacatcataaaaaccatccaacagggagaaatttataagatacctgcagcagaaaacaacccttttcttgttggaatgcattgttggtactccagttacagccaccggacccagcactgcaatgtttgtcgagagagcattcctgccttatctagagatgccatcatctgtgaagtgtgcaaagtgaaatctcacagattgtgtgctttgagagcaagcaaagactgcaagtggaatacattgtctatcactgatgacctccttctgcctgcagatgaagtaaacatgccccatcaatgggtagaaggaaacatgcctgtcagctctcagtgtgcagtgtgtcatgagagctgtggcagttatcaaagacttcaagacttccgctgcctgtggtgtaattctacggtgcatgatgactgtaggagacggttttccaaggaatgttgcttcagaagccatcgctcatcagtcattcctcccactgctctaagcgaccccaaaggcgatggccaattagtagtatcttcagacttctggaatcttgattggtcatcagcctgttcatgtcccttgctcatcttcatcaactccaaaagtggcgatcatcaggggatcgtcttcctccgaaaattcaagcaataccttaacccatctcaagtgttcgacttattgaagggtggacctgaagcagggctgtctatgttcaagaactttgctcgctttcgcattctggtttgtggtggagatggcagcgtgagctgggtcttatctctgattgatgcctttggattacatgaaaagtgtcagttggcagtcatcccacttggaaccggcaatgatctggctcgtgttctgggctggggtgcattctggaacaaaagcaagtcacctctggacatcctcaacagagtggagcaggctagtgtgaggatcctagacagatggagtgtgatgattcgtgagactcccagacaaaccccgctgctaaaaggacaggttgaaatggatgtaccacgatttgaggctgctgccatccaacacttagaatctgcagccaccgagttgaacaaaatcctgaaggccaagtaccccacagagatgatcatcgcaaccagattcttgtgttcagctgtggaagattttgtggttgatattgtaaaggcctggggtcagataaaacagaacaacactgcaatagtgtctgtgattttgaaaagtgacttaatgtatgataggctcagtgtcctgatcgatgtcctggctgaggaggcagcagctacttctgctgaaaaaagtgctacagaatatgcagacagcagcaaggcagataggaagcccttcattcctcaaatagaccacatagccaagtgcaagttggagctggctacaaaggcccagagtctccagaaatccttgaaactcatcatatttcaagttgaacaagctctggatgaggaaagcagacagacaatatctgttaagaactttagttcaactttcttcctggaagatgacccagaagatattaaccagacaagcccacgacgccgttctcgtcgtggcactttgtcttctatatcttctctcaaaagtgaggacctggacaaccttaacttggatcacttacattttacacctgaatctatacgcttcaaagaaaaatgtgtcatgaacaactacttcggaattggactggatgctaaaatttctctggacttcaacaccagaagagatgaacacccagggcaatacaatagccgccttaagaacaagatgtggtatggccttctgggaaccaaagaacttttgcagcgctcttacaggaaactggaagaacgagtgcatttggagtgtgatggagaaaccatctccttgccaaacctgcaaggcattgtagtgctcaacattaccagctatgctggaggtatcaacttctggggaagcaacacagcaaccacggaatatgaggctcctgcaatcgatgatgggaaactggaggtggtggcaatctttggttctgtgcagatggcaatgtcccgtatcatcaacctgcatcatcatcgcattgcccagtgccatgaggtgatgataaccattgatggtgaagaaggtatcccagtgcaggtggatggggaggcctggattcagagaccaggccttatcaaaattagatacaagaacgctgcccagatgctgacaagagatcgggactttgagaactcaatgaaaatgtgggaatacaagcatactgaaattcaagctgcccctcaaccccagctggacttccaggactctcaagagagcctctctgacgaggagtatgcccagatgcagcacttagctcggcttgcagaaaacctcatcagcaaacttaatgacctgagcaagatccaccagcatgtgtctgtcctcatgggttctgtgaatgccagcgctaacatcctgaatgatatattttacggccaagacagtggcaatgagatgggtgcagcttcctgtattcccattgaaactctaagcagaaatgatgccgtagatgttacatttagtcttaaaggtctctacgatgacaccacagctttcctggatgaaaagctgctgagaagtgctgaggatgagactgcactacaaagcgccctggatgccatgaataaggagttcaaaaagctatctgagattgactggatgaatccaatctttgttccagaggaaaaatcttcggacactgacagtagaagcctcaggctgaaaattaagttccccaaattgggaaagaaaaaggtagaagaggaacgcaagcctaaatcaggccagagtgtccagagttttattggcaatttatggcaccgcagacatcgtgaagatgaagcagagggtgatgatcctctaacaccatcgagatctcaactgtagcccttgaaagctggaagaactcacaacattgagaattctactaaaaaaactctcaaaacc

SEQ ID NO: 2976 - DNA, 2734 bp, Homo sapiens
ggaacctggcattgatcctcagtttagaacaggccagttaccatattgtccggagtgggtccttgacattcaggaaagatacatccttagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattgc

SEQ ID NO: 2977 - DNA, 4675 bp, Homo sapiens
cgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaaaa

SEQ ID NO: 2978 - DNA, 4761 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatg

SEQ ID NO: 2979 - DNA, 4584 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttgaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatg

SEQ ID NO: 2980 - DNA, 4794 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatg

SEQ ID NO: 2981 - DNA, 4656 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatgggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatg

SEQ ID NO: 2982 - DNA, 3270 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccatatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgaaagctataaaatttcagatttaa

SEQ ID NO: 2983 - DNA, 3449 bp, Homo sapiens
atggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattgcacattcttcttatctacttttatcctattgatctgtgattttagtagactgctgtgaaattctcaagttccaatataactaaaatagtaaaaatgtgtgcatgta

SEQ ID NO: 2984 - DNA, 2090 bp, Homo sapiens
atgagtagccagccagggcagaggccgggctgcaggtggaggcggggaagcgattccggccacctttgtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacagtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggt

SEQ ID NO: 2985 - DNA, 3725 bp, Homo sapiens
atccagcgcagccgggagacagatgcgaggcggcggtcagcaggtgccgaacccacggccaggcttccgtggccagcagccctagaggaatggccatcctgtccctgcgagcccctgggccctggcaggcgatgcaggtatgggcagacaggacgctgttgactccgcacaccggggtgacttctcaggttctcggggtggcagctgcagtgatgacaccgcttcctggtggtcacgccgcgggcaggacgcgggaggccaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 2986 - DNA, 852 bp, Homo sapiens
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattaca

SEQ ID NO: 2987 - DNA, 4450 bp, Homo sapiens
agctgaatcttccacgcgagaagcctaagagtagggatacgggggcggggagcagcaggcctgctctgtgtgtaaacaacgggaaagcaggaataacgccagggcccgcggacaccagctgcctccgaagtcccgctgcccggcgcctgcatggagcagcctcctgagcgcagtgtggcgcgtcctcctgtgtaaagagggtagagccgcgccgggtccctccctctgcagccgtgaagcccccgcggggccctgcaggtggctggcggcacctgcacacggtggttctctgttcctttttcctcctcaaccactgaggttaaaaaaagtgttaaaagccaccctttttgtttttttgagacggagtctcgctctgtcgcccaggctggagtgcagtggtgcgatctcggctcactccgagctccgcctcccgggttcacgccgttctcccgcctcagcctcccgcgtagctgggactacaggcgcccgccaccgcgcccggctaatttttcgtatttttagtggagacggggtttcaccgtgttagccaggatggtctcgatctcctgacctcgcgatccgcccgcctcggcctcccgaagcgctgggatgacaggcgtgagccgccgcgcccgcccattttttttaaacgtgttggggtttgggtttcagccacaggccttctgcgatgagaggaaacccaggacgcgcagccccaggtcaggcccgcggaacagccgggcggactccggggctcgcagactcgcgacccgcgtgccatgaacctccgcgccggaggcggcagcagcgagcgcggggctggatccagcgtagcggggcggccgggcggatccagcgcagccgggagacagatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 2988 - DNA, 3549 bp, Homo sapiens
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttt

SEQ ID NO: 2989 - DNA, 1081 bp, Homo sapiens
ctggagggaccgaaggtgccgagggctccgcatcgcaaccatggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtggaggtggcctacattggcacccagcacccccagcacaaggcggcggtgatgctgtgcttggcggcgggcaaggccgttctgtgcgagaagcccacgggcgtgaacgcggcggaagttcgcgagatggtcgcggaggcccgatcccgagccctcttccttatggaggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacaggtgtggatgacactgtcacggtgctcctgcagtacccaggggaggtccatggcagcttcacctgcagcatcaccgtgcagctctccaacacggcctccgtgagcggcaccaagggcatggtacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttacatcttc

SEQ ID NO: 2990 - DNA, 1861 bp, Homo sapiens
ggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcg

SEQ ID NO: 2991 - DNA, 2084 bp, Homo sapiens
gaaggaagctctgcccttcccctggcccggcgcggagccgattctcccgggaaggggccgggggtcctaacttcaccgccgggcggcctgctcagggccaggcccgcggggacgctggcgtcaaggtttcttcccccttcacgccagtcccctaccaggccgacatcgagtcccgctccccagggagggtcaagtcccaggggtccagcggctcccccgaggtccgctaggaggtggcggcactggagtggccgttctccagcctgcaccgacccccgcctttagtgcccccgcgtgtgacccaacggtggtactggagcggccttagaagggtgaccgctgcctctgagttgagtcttaagcccctcgttgggcctggctgaaccccgggtctgcgcctttcccccagcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcc

SEQ ID NO: 2992 - DNA, 1224 bp, Homo sapiens
cccagttttgctggcccacgagaaactctccctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaa

SEQ ID NO: 2993 - DNA, 1410 bp, Homo sapiens
tttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagagttttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttc

SEQ ID NO: 2994 - DNA, 2109 bp, Homo sapiens
gacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 2995 - DNA, 1383 bp, Homo sapiens
gacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgagctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 2996 - DNA, 2217 bp, Homo sapiens
gaatcccggcgccgcccgcccacccagcccatggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgttcataattaaagtattattttgttttgccaacatgaaaactgttataaggaa

SEQ ID NO: 2997 - DNA, 1375 bp, Homo sapiens
cccagcccatggctccaggcccacctggcgaactgactctcagcccgcgcctgggctaagcctggctaggagccgcgcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaa

SEQ ID NO: 2998 - DNA, 5817 bp, Homo sapiens
gactgatcatttggctcttgccggaaatcgttccgcccggtgaggtttcggcgtgagacccgaggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaa

SEQ ID NO: 2999 - DNA, 5056 bp, Homo sapiens
cccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaccaa

SEQ ID NO: 3000 - DNA, 4583 bp, Homo sapiens
atgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtacc

SEQ ID NO: 3001 - DNA, 4583 bp, Homo sapiens; identical to SEQ ID NO: 3000

SEQ ID NO: 3002 - DNA, 2392 bp, Homo sapiens
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaa

SEQ ID NO: 3003 - DNA, 3337 bp, Homo sapiens
cggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggctttt

SEQ ID NO: 3004 - DNA, 5056 bp, Homo sapiens; identical to SEQ ID NO: 2999

SEQ ID NO: 3005 - DNA, 4881 bp, Homo sapiens
gcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtacc

SEQ ID NO: 3006 - DNA, 648 bp, Homo sapiens
tgctagttcttatccctggacctgaacccaggcgcacatctggattagaagatgccaggctcagaggatcttcgtaaaggcaaggaccagatgcattcacacaggaaacgaaccatgttcactaagaagcaactggaagatctgaacatcttgttcaatgagaacccatacccaaaccccagccttcagaaagaaatggcctcgaaaatagacatacacccaacagtactgcaggtctggttcaagaatcacagagcaaaactcaagaaagcgaaatgcaagcatattcatcaaaaacaagaaactccacaaccgccaataccagagggtggggtctccaccagtgtcggcctgagaaatgcagacacactacccagattgcccaacgctgctcacccgatcggcctggtgtacacgggtcatcgagtcccctcattccagctcatcctgtaccccaacctcaaggtccctgcaaatgacttcattggccacagaatagtccattttggctgctgccgagatcctaatatatactgcctctaccccattttggaatcccaagtttgcgctccaagcttccattctggctctcctgcctgttcatctaaccaaagtcgagagagatgataaatacaaaaagtcacatgt

SEQ ID NO: 3007 - DNA, 5897 bp, Homo sapiens
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaa

SEQ ID NO: 3008 - DNA, 905 bp, Homo sapiens
agaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggca

SEQ ID NO: 3009 - DNA, 1282 bp, Homo sapiens
ctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 3010 - DNA, 905 bp, Homo sapiens; identical to SEQ ID NO: 3008

SEQ ID NO: 3011 - DNA, 1197 bp, Homo sapiens
actgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 3012 - DNA, 1100 bp, Homo sapiens
agaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggca

SEQ ID NO: 3013 - DNA, 1042 bp, Homo sapiens
ctctcccggaatccctttcgggaggactccttgctccagccccctgagccctggcctttggccaatgaggcagggctcatgggattgcttttgattcggaggtccgggagggagtggatgattgggcttcctgaggaagtgagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 3014 - DNA, 472 bp, Homo sapiens
ctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtg

SEQ ID NO: 3015 - DNA, 458 bp, Homo sapiens
accgtctgactggttctgacttgccggaggctgaggcaaccacaggctgacatcagaattagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctct

SEQ ID NO: 3016 - DNA, 1100 bp, Homo sapiens; identical to SEQ ID NO: 3012

SEQ ID NO: 3017 - DNA, 2615 bp, Homo sapiens
agaaatggactttggaacacaacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaacccccacgatctgtccctgctcaaggaacgcaaccctcccttggcggaagccctgctcagcggaagccttgagaccttttctcaggtgctgatggagcagcaaagggaaaaggccttgagagagcaagagaggcttcgtctctacacagccgacccactggatcgggaagctcaggccaaaatagaagaggaaatccggcagcaaaacattgaagaaaacatgaatatagcgatagaagaggcccccgagagttttggacaagtgacgatgctctacattaactgcaaagtgaatgggcatcctttgaaggcttttgttgactcgggcgcccagatgaccattatgagccaggcttgtgccgagcgatgtaacatcatgaggctggtggaccgacggtgggctggggttgctaaaggagtgggcacacagagaattattggccgtgttcatctagctcagattcaaattgaaggtgatttcttacagtgctctttctccatacttgaggatcaacccatggatatgcttctaggcctagatatgctccggagacatcaatgttccatcgatttgaagaaaaatgtgctggtcatcggcaccactggcacgcagacttattttcttcctgagggagagttgcccttatgctctaggatggtaagtgggcaagatgagtcttcggacaaggaaattacacattcagtcatggattcaggacgaaaagagcattaaagcacgttataaatatgttaccaccttgagggagcctcaggtccccggcaattataagttaagagcttactggcaatgtaatcattaaaaaacatcagtaacaactaaacctggccttgggactacgttctcagatgggtaactaacgtcaatcctgattccttggtcttggtccctcttccatttcccttgtccagagatcactgaaaggcatcctgggaaggctctggaggctccagctgatttccagataatccatgaaaaagaaaaccagcttcttcctttagagacactatcctatcagattacaggtggcttatccaaatcattgctattttgcagaattccctggaaaaatgctatggctgcagaccttacaaggcatccacataaaactatttcacatcagcactaataattctttctactgagagaaatatgcccattttcacaggttttgttttctttgggaagggtattagaaatggtaggtcagttacactatgatgttaactaatacttatacatgtctgtttggggcagcataaagaccaatttcctcatatttacaccttcccttcccctggatcccctgcagtcaccctgcaatccacagctaaagactatttttgccatatttgagaaagtggatttatctccaaggatgctacattaattttctatttctcctgcattcaaagaaactctggctataaaacaaaggcaataaattagattttttaaaaaagaaattatggtacttcttgggagtcaagttgtacagtggtgggaatgagaggtggggacaggcagtggtccaggttctctaatagtcattgcaactagatcatctctctctctttttcaaagtaaaaatctgctttatacattaagctgctgctacatcagtattgtttgaacaaaggttttcactgttaaaataacatttgaaaacttttgaatgagaagatctctaaggcctcattcagaattatccattctgacaatgttagtgtttattacaactgacagtgggtaatggaagatcctagacttaattacaacccatggctaaagcacctgagagaaaagtttcagcttcctgaggccatcagatgcaggggaaatgtttcaggacaataatttatcaaaactagtattaaaacagcggattcaaaatc

SEQ ID NO: 3018 - DNA, 10625 bp, Homo sapiens
gagggcgggagggagtgactcactgagcgtgtgtgagggagggagcgagcgagcgaacgagcagccggcgccgtcctcccgcagcaccagccaggccacgccgccgcctcttcccctgcgccccgcgcccaggccgggccgagccgagccgagccgggtcgggcccgggccatgctgctcaccgtgtactgtgtgcggagggacctctccgaggtgaccttttccctccaggtcgacgccgacttcgagctgcacaacttccgcgcgctgtgcgagctcgagtctggcatccccgcagccgagagccagatcgtctatgcggaaagacctctcacagacaaccacagatcattggcttcttatggcttgaaagatggggacgttgtgattttacgacagaaggagaatgcagaccctcgacctccagtgcagttcccaaacttaccccgaatagatttcagtagtatagctgtgcctggcacatcaagtccccggcagcgccagccaccaggaacacagcagtcccactcatctcctggagaaataacttcatctcctcagggcttggacaatccagccttgctccgagatatgttgctggccaacccgcatgagctgtccttgctgaaggaacgcaatccacccctggcagaagctctgctcagtggagaccttgagaaattttctagagtcctggtggagcagcagcaggaccgagcccggagagagcaagaaaggattcgtctgttttctgctgatccctttgaccttgaagctcaggcaaagatagaagaagatataaggcaacagaacattgaggaaaacatgacaatagctatggaagaggctccggaaagttttggccaagtagtgatgctttatattaactgcaaagtgaatggacatcctgtgaaagcctttgttgactcaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgtagcatactgttttagaatgagagtaaatgctttgaaaagcagaagccatgagaaatcccactacccatccagctaaaaacagatgaactctccacactgtgactgtgtgtctgtgctgatggcaaggtatggtttgctggctcagttgtcaatttagaaacttttgaccacataatttggtgtttggaattctacccagtgctctgtgtatcatgattcattaattataacaggaaattggagaataattgaatatcttatcgtagagtggtatgtttttatttgtgtgcttaggatttgacattttaatagggcgagcaggagggtttaaatcttgggctactttgtgcatcacaggctgctgcatggattgccatgaatccttattacattggatgggatattgtgggggagttacaatgcaagtgaaacgtggtgctacccagattcttaaaagaacagaacaaccataattccatttgcagatgtcaagaactgtgagggaaaaataatggcctaaacactggaatttgctagagtttgggtttgctagcatctcactgataacacctcaacccttaatgactaatggtggaattaagttcaggaatggattcattgccagcagcttatttcctttctagactcttctgccaggaagttcttcaaacgctcagtgtgagctgtgatctgagtgaaatactaagtgtgataaccttgtcactggttaatcttggtgcttggaacggtcagtctatttggagagtgtcctttgtggcagtggaaatagtaattacagtttctgacttaagtggccttggtagagttttccatccttttctttcctcaggagtttcttttttaagcaaaattcatcttatttgtgtttaccatgtcaagttagagtggggcataatatatagatgtatttattgtggcctttttttatataaggactagcccttggaaatcattgtcctgtgggccccactgtgcaataatcctactggataggttttagataattctttcctggcaaactgctcttttgggtacctagcaggaatctgaagtcttggttttattgaaaagaattttgagattcataatttctgattctagattatagtttgtaacatgtttgaaacagaagcttcgaaagagtgatttctcaacttagtgttaaatgattttgtctgaagtctgactctttgtaagcttgtttgtttcatcaaattttaagtcattgagcacaatcaaaatggaggctcatatctcaggagtttttgaaattttaatttaggggcacttagagacatttttttctaccccatccaacttctttctttccttttgctatgatgtttgtatgtatgttataagactttagtgatgggatggcgtgtcacgtagattcatcatgatcctttatgtagttaggaaatggttgacagaaggaattgtagtttactgcttttcagagggcgtgaagaacaacaggtcagccaggttgtctttaagatgttcttttagacagctgcacattgtagaccctttcacctgccctacaccaaagatgtacgatgcactaggaaactgctcataggatttctgtcagctgacttaaagctgtgattgtaattaaatagttggtgctatgattgatgcaaaatctagtagcaatgcaatgggaccctgtatttgctttatgggtggtggtttgggaatgtattctaagcttataaatctttggaaccacggggtgggaagggtgggggaacttactgatgacaatagactccctcctaaagggccttccatgtaagcagaacgaaccttggcacacaattcagtgtggatatttgggaaacagttccaagtggaatatataatatcagtcgggaaaagatttcattaggatagctttttgtgtatgtatatgtatatttatttttaggaatagatctatagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaggctcggtggctcacacctgtaatcccagcactttgggaggccaaggcgggtggatcacctgagggcaggagtttgagacaggcctggccaacatggtgaaactccatctctactaaaaatacaaaaattagccgggtgtggtggcccatgcctgtaattccagctactcgggaggctgaggcaggagaatcacttaaacctgggaggcggaggttgtggtgagcagagatcacgccattgcactccagcctgggcaacaagagcaaaactctgtctcaaaaaaaaaaaaaaaaaaggtaaccagttgcttggcaaaggaagctggagagatggcgagtgcatgtgttaaaactcttctgccttgcagcccacatcttctagagctccctgtcttcatatgtactaaagggagacacaaccctatgtgttttttcccaaagcatgtctctagcaagagggtacatagaaatggaacatgaggctttttgtcactgattttatgataaccagttaatgtggaatctgctggttgtcttactacagctttctatctccggtgaaagccataaaaatttaggttaacttttaagctcatgtctatatatatgtgtgtaagctagcatatacatatggtgattgacaagtatagttaattttatatggatttaaaagcaagcaatttttatatctacagacgtactcttcacttatggtggcttttatcccgccacatatataaatatatatatatatagcaaacagccttgcaaatcatcggccagaaaagctgcagggcgttgcaatggccttttcctacctgtttgccacctgtggtgagggtgagcaggatgattgaactgctgcatatttcaaacctgttatcactggcagtgtgtcccaagagaagctgaccagattatgcattctactgttctctagcacaagtactcaccaaaaagccaaatttcccctttggagttggtgacttagtgtagtctgtggctgacctagaaagacacagagttatcaagagtttcccttcctagaagatgaatgttaccttttgtgttaggaggtagagaaaataaaaatagcttttttttccctagaattgctaattactcttaacaacaaattaaattcaaagcctgtccttgagaactggaaatgtaaaatcatggttcaagttttataccttagtgattcctcagtaggtgttactaggagttcactgaatgaacttaggagtgaaccttcgatgtgcttgattttcttttgtgccttagtttctctgaatagcagaggcatcaaattttggtggggaatgagaggagtattaggggaaagtttgaaaatagctctcctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatccatcagaccacctcacatgcagggtagaaacatggagtgtgcggcagcatcctcctcacatccctttgtgagcacggctgctccggaatactgaccatctgggctagcacgacttagcagagggttctgcaggatgtgctattttaaagcagctgggtgcaacttgtgaaaacgggaatctagagcagaacatgtaatcagcgatggctgggattggtggacaggattgacaggagtatttgaggctctaccaggcctgtctacaggacagcttcatcaaagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccaagaaaatggttcaagggcatgggggttagagaatgtttcttttacctaaaaatgttaagccaactatggaagattggggtcgtgggggcatgaaatacaaaattatgataatttatacagaactaggtttctttatgttctgcaagaaggtttttattagctaatttggggaggggggcatgctgcagtattttttttcctgggaacatgcatttctgatgggaagttattttgtttacaagagttggttttacacacaaccctgaatgaatgtgtctatggcctaaaaatggtagacctgtatttccttcccgaggcaggctgattcgtttcctgattccttctgtctgagattacctgatgctgaccagacttatttttcctttcctgaatcttcacagctgagtttatggcacccatccaagaccttcccatttgaatgactagatttctattctatccccgatcatccttttgaaatagttctagtgataaactcagagaaattcaatatattgattgaattttattttttcgctttgtatctacaacagaaattgatttgttcatttttatttcaaatctcttcatggcaagttgggctaatggactttgcactcaagaaaggtttgtttaccagttttgtagccatgtttggcaaatcttagcaactagaaaccccgtcctttcttttccttctttatatgttcttgcagttactcttgtattgcaagattttctgactttaagctttgagactactgcatcttaaaagaagaactaggctgactggcaaaaagtcttgccagtggccctgtcactcccatgatgctttggttttgagagttgggaaaactctgagaacttaagggaaccaaactcaggaatcccaaaattggtggcattgtgccattcgtttaggggctgaacataggacctgtctgaaactgagtgagctagatgcatttgggtttgaatttttgtcacatactgaaatgtaagtcagccctaaataatcaaaacactttattttatttttctttttttaaataggaactttctgaagaaaaagtggtgtgtaaaacatttgatatttaagacaataaagtttttatcataaga

SEQ ID NO: 3019 - DNA, 1625 bp, Homo sapiens
gcagaggcgcggcaggggggcgggagccgcggaacccctaccccaggtctgcgcaggtgaggagggggcggggcaggaccgacctcccttgccatgataaccaccttcgcagccggctcccagaccgttggcaccgattgcctagaaaatagggggtctcaggagctccgttttagcgtttatatatcccaattccaattaagccacttccagtattttttggccattgtcagtgtacaagtcttcctcctcttcgagaccatgttattgcaatagcagcaaacgtgttgggaggcctcacaattcatcatggtttttctggcctctggcagatagctccttcctagcgagctgtggagcttaaagtcttttggacacttgattctattcaatccagtatcagaccaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatca

SEQ ID NO: 3020 - DNA, 1354 bp, Homo sapiens
agctggtggtccccggtcgggacgaaggctcccgaggtgccctgcctgggtcctccggggtaaagttcgtttggcggaagattgtccgttttcctggtaaggtcacctgtcccaatcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatcattcttagttccactgaca

SEQ ID NO: 3021 - DNA, 2381 bp, Homo sapiens
ggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccaa

SEQ ID NO: 3022 - DNA, 1537 bp, Homo sapiens
ggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctctaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagc

SEQ ID NO: 3023 - DNA, 1454 bp, Homo sapiens
ggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatat

SEQ ID NO: 3024 - DNA, 2961 bp, Homo sapiens
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 3025 - DNA, 3116 bp, Homo sapiens
ccaggcgtggaagtcggtccggcgcggggcggggggcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgccccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagag

SEQ ID NO: 3026 - DNA, 3245 bp, Homo sapiens
agacggcggccacacccccggggagaggccgggtggggaccgcagggcgcagctctcccagtcccacccttcggcgcagggctccggccaacacagccctccaggccgcctactctccagccagccggctccacggacccacggaagggcaagggggcggcctcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 3027 - DNA, 1399 bp, Homo sapiens
agtctcctttaaggagagcttgtaggcttctaatttcacatttcagcaagctggctaaagacatgtgggaaagcctgaccctggattcaggtcaaatctcagcactcacaagatttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgca

SEQ ID NO: 3028 - DNA, 1875 bp, Homo sapiens
taatgtaagatgttaataataggggaatgtgaatgcagtggctcacacctgtaatcccagcactttgggaggccaagccgagcccaagagttcaagaccagtctgggcaacatggtgaaaccccatctctacaaaacatacaaaaattagccaggcatggtagtgcacgcctgtgtctcagctacttggaaggctgaggtggaagaatcccttgagcctgggaggttgagactgcagtgaggtgtgatcctgccactgcccaccagcctgggtgacagagtgaagaccctgtctcaaaaacatgataatgataataataataataaaataggagaatgtggatgtgaggtatatgggaactctctgtactgtcttctcaacttttctaaactctaaaactgttctaaaataaatgtatttttaaaaaattagccaaatgcatttcttctaaaacctttttattaaaactaattactgctctctttaaaaacaaaaacaaaataaaacagagccctgtgagtcttcaatttccgagttgagtgacctttcacagggtcgcagaatcagccccagctctcccccagtcctttcactgactcctctctgtggcagagctgaaatttgtttagggaagtgggactacaactcccagagtgcacctgtgcggttgtcaggagcaaccaaggaagccaactaacagccttgctagagtctgaggactatccagggcctgactgccagctagccagccatgggccaggattattactctgtgctcgggatcactcgcaattcagaggatgcccagatcaagcaggcgtaccgcagactcgcccttaagcaccacccgttgaagtcaaatgagccgtcttcagcagagattttcaggcaaatagcagaggcctacgacgtgctgagtgaccccatgaagagaggcatctacgacaagtttggagaagagggcctgaagggtgggattcctttggagtttggatcccagaccccatggacaactggttacgtcttccatggcaaacctgaaaaggtgttccacgagttctttggtggaaacaaccccttcagtgagttttttgatgcagaaggaagtgaggtagatttgaactttggggggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgggatggcgcagggcttaaactgacataataaagatctatttcctgtcctccagctaca

SEQ ID NO: 3029 - DNA, 912 bp, Homo sapiens
tctgggtctctggatacaatttctcttactcctctccctacctcctgcagagttttttgatgcagaaggaagtgaggtagatttgaactttggggggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccaggcccttccagaaaacctgctctcatctccccattgtacagatgaagacatggagacaagtagaggcaggaacttggccaaggtcacacggccaactagtccttgtcaccttttggcgtcccctgcccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgg

SEQ ID NO: 3030 - DNA, 1779 bp, Homo sapiens
agtgcaggagtgccctctgcagccttcccaactgggacaggctctttcccttcctttctttcagttcagccccatccccgtgggaactggaaaggctctgaatgggaggagtctcttctgaattcttccttctgggctttaccagaccatattcccaggatttcatcagggtgcatgcctcgtgcataagaaagaacagtgggcatggagggtgggctgggagatagtccccaaggtgacgggttgaggaagaccctcagtgcctcatgtctagtccttggcttggccctgtcccatggcccagccctgtgccaggcataagagcaagccccctccacctttgcccagcagaggagatgccgatgcggccatgctttccacagatggaacccatctggacatgcgactggggagtggaaggatccccagtggggaatgcactgggggaggcttagatatgttgactttcatttctctctttgggattaagagacttgctggaggctcagggccgggcctctgggatttggagagaggaatggagtacattttcaccatgtatctgttagtggccagggctggagctgtgtgtttgatcaactaatggtgactgcttggcatctcagcccccagccccagtctcatggcatcctctgccatactggaatcataagttcttggttgtcatggcaacaggatgggagtgggagtggctcagggcaggctctccccattgctggaggctcttcccattgctagaggattgagcccaagtacaaatcccatagagcatctttcacgtgtgcaaaggtcacctgagtgttcatgaaaatctgagcaaatctcgactgtactcatggaagtcctaagcagacctccccacacctgatatgttgctataggtgctgaacgaggatgggtactcctccaccatcaaggacaagatcctgaccattgatgtgaagcccggttggaggcagggcacacgcatcacctttgagaaggaaggggaccagcgcccagaagagacctcagcagagttttggtgacttaatgaagtttgggacaggggtgtcatgcctggagttactagcaagacagagacatacgggcagttgcctgacgcccagcttagtgttccacctgcctgccgtctgaggaagcctctccgcccctccagctgagtgtgtctattttgggcatgctcagtacagaagtaattctggggggattcatttggatgaagacatggagacaagtagaggcaggaacttggccaaggtcacacggccaactagtccttgtcaccttttggcgtcccctgcccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcagggctacacccacgagagtacattggagaggagcttcatattagcccttcttgtggggcacagggaagaaagaggcctaaggagctg

SEQ ID NO: 3031 - DNA, 2578 bp, Homo sapiens
taacattgtctttaacataaaagtgtacctatttgcagtcactacctctatcaccaccaccagcagagcctgagctgaggaaaccacggttctcaatacccagcacacccacttccaactatctgttaaaacatggtggattactatgaagttctaggactgcaaagatatgcttcacctgaggacattaaaaaagcttatcataaagtggcacttaaatggcaccctgataaaaatccagaaaataaagaagaagcagagagaaaattcaaagaagtagctgaggcatacgaggtattatcaaatgatgagaaacgggacatttatgataaatatggcacagaaggattaaacggaggtggaagtcattttgatgatgaatgtgagtacggcttcacattccataagccagatgatgtttttaaagaaatttttcatgaaagggatccattttcttttcacttctttgaagactcgcttgaggacctgttaaatcgtccaggaagctcctatggaaacagaaacagagatgcaggatactttttctccactgccagtgaatatccaatttttgagaaattttcttcatatgatacaggatatacatcacagggttcattggggcatgaaggccttacttctttctcttccctggcttttgataatagtgggatggacaactacatatctgttacaacttcagacaaaatcgttaatggcagaaatattaatacaaagaaaattattgaaagtgatcaagaaagagaagctgaagataatggagagttgacattttttcttgtaaatagtgtggccaatgaagagggctttgcaaaagaatgcagctggagaacacagtcattcaacaactattcaccaaattctcacagctccaaacatgtatctcaatatactttcgtggacaatgatgagggaggtatatcttgggttaccagcaacagagatccccctattttctcagcaggagtcaaagagggtggtaagaggaaaaaaaagaagcgtaaagaggtgcaaaagaagtctaccaaaaggaattgttaaattgactcttcaaatatataacatttgaacacaattgtgtgtgttttggttaatcacaaattttgtagataacacttaatactatactaagagcttttcaacacttttagcaggattgtggacatttggttagtagtttttttgaatgggtatgtcagaaaaggatgagtttgtggtgacagttggtgctaataagaatttgcctgggcagtatagtgagatcttttctctacaaaaaatttaaaaattagccaagtgtggtggtgtgcacctgtagtcccagctactcgggaagctggtagaaagactgcttgagcctggaagacataggttgcagtgtaatgggatcacgccactgcactccagcttgggtgacaaagtaagaccctgtcttaaaaaaaaaaaaaaggaatttggaaaactgcaatgagttttttacttttgaatttttctttagtagagtttatagcctatttttcttttttctaattaaaaccactatacaaacttacgaaacatgcatagcattagaagacaagaatgtatcaagacacacaggttcagactacacaattattcatgaaatggctgttttccaatggaggaacagcatttgatgcattataacttaaaggtactacaaattaaaaattaaagtataaagtattttaagttagaaatagacttagctgggtgcagtggctcacacctgtaatcctagcatcttgggaggcccaggcaggagggttgaagtcagaatttcacgacagtccgggtaacataatgagacctgtcctctatgaaaaaacttttttaaaaatttagctgggtgtggtggtacgtgcctgtaggcctagctacttaggaggctgaggtgggaggattgcttgagcccaggagtttgaggttgtagggagctatgatcttgccattgcactccagctgagagtgtgaccctgtctctaaagaaaaactatagaaaatttaaaaaattaaaaaacgggtaacatggtaaattttatgtagtatattttaccacattttttttaaaggccagtcttatcctgaattcctcagagcagtctgtatggtaggccatcagtgaatcactccagacaggaaattttctatttttgtttagagtttgtacacaaaatctacaaatacattactctaaaatagcacctatagccattttaatttagtcatgttgggagaaaaatagatgggttacaaatacatcagatatcgagcaaatggtttgagttacatctagcagcactaaaacttattcaactttggccaaatacaaatgcgaaattagaaaaaaattataatatctgctatttttaaaagacagctatagtcaagagcttgtgttttgtatcggtatttgatttttagtgggcagatgggagaaggaaaggttatttattctatagaagagactgcggacaattagtattcaaagtttattttcagaaaataaaataataaaagcccagggtattttaaa

SEQ ID NO: 3032 - DNA, 2465 bp, Homo sapiens
acaccgcctttgccatcaccaccgtcattgccccctctactaccaccaccatcaccaccaccgggtctgcctcagccagacccaccactgcctctaattagactgccaccatcatcactgccaccaccactgcccctccaatgccttcctgatgtcaccatctgctttctctctgctatcctcacacccaactccatcaaaaccaccaccttcatctgagccgccatcaccctcacagtacacagccctcaaatgtgtaccaaggaggaggacatttactacacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctagtctggaattataccggtgatgggattctggaaaatccctcagatttctccaggatgcaaggagaccatggaagaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgtagaattgagtggaacacttctttggatttgctgtccgctgcagccttggccctggtttcacatcccctccctcactgactcgctgtgtgaccttgagcactgtgtgtctctgagcctggttcatccaagagtttaccgacggccctcgtgtgccagccactgtcctagacagggacagactttcccgcctttgtggagcttaccccggaagacctggccagataatgggcacaaaaaaagcaggctcttgtccccaccccagcctgcctgaaccccaccttggcctcctcttgcctcagctgctgcccagccatcggccgagtggacatacccaggacgcccttgcccgcctcccccaccacggccacagacctttgtcactcaccaaggctggaatcccgtggctgatcctgcctctgccctttggctcccgggactcagcccacaccacctgggtcacagagcatcccattcccacacaccgttgtggccacctcaccagcaggggcaggcccatatgcccaggtttgcctggtgaggagctgggggcgggggtatgccccgccccgggagctgacgtcataaaaggagctctggagggcagcccactctggcctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagttttttggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtga

SEQ ID NO: 3033 - DNA, 3365 bp, Homo sapiens
acacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctagtctggaattataccggtgatgggattctggaaaatccctcagatttctccaggatgcaaggagaccatggaagaggttggtgtaatgccaagttagcaacagaaaatacagagccccacacctcagtgccatcaccatcgccatcggcactcacaccagcatgtccaccactgtgtccttctcacccctcggcacccccctctaccattgcctcttccacaaccaccctcaccaccatcctccattaatagcacaattcctgcctcctatcccatcaccaccacgggtgtccccggcaccagcagcaccaacactgctcccagcagagccatcgttaccagccccgctgtcagtcccatcttgagcatctggcatatgttggagaactgctcactccctcttccccatgggaatctcaggcctctcttcctattgccctgagatttgcagaaccttcctgaaggaaacattctttgccccatggatactggccttgaccatgggatgcagcaagactgccacacatcatggcccaacagaagctttcagaggcagcccaagttcctgctgtctctgagtggcactgtcatgagagaggggtgtgcaggtcagagctgattctccagcctgggacccacagtgagaagctatgggaggtggggccctggcagctgcctgtaggcaccagtgagtgaagtggggggaactagatgtttgtcgtgagccactgagaggtggaagctgtcactgtggtatagccgaacaagatacaacctctgctacctccaccaccttcaccttcatcatcaccattactgtcaccactgccaaccacaccaatggctcactaggagccattcccatcacctcctcatcatacctgcaccatcactgccaaccacaacaaaggctcgctgttaccatctcctctggcatgaccatcaccaccaccactaccatcatcaattactctcaagcacaagccttgctgctgtcaccaccagcatcaccatcatcatgatcaactccaccatcacccataattactctccccctcacacccaccatgaccattacctccacatcaacactgctcccatggtcacctctactatataatgacaccttatccatctccatggacacccaccgtgcctctccccaccagcaacacagtcaacagcagtgcctctcccactgccaccgccatcatggagaactgtgcagggcaagcatctttctcccgccccaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgtagaattgagtggaacacttctttggatttgctgtccgctgcagccttggccctggtttcacatcccctccctcactgactcgctgtgtgaccttgagcactgtgtgtctctgagcctggttcatccaagagtttaccgacggccctcgtgtgccagccactgtcctagacagggacagactttcccgcctttgtggagcttaccccggaagacctggccagataatgggcacaaaaaaagcaggctcttgtccccaccccagcctgcctgaaccccaccttggcctcctcttgcctcagctgctgcccagccatcggccgagtggacatacccaggacgcccttgcccgcctcccccaccacggccacagacctttgtcactcaccaaggctggaatcccgtggctgatcctgcctctgccctttggctcccgggactcagcccacaccacctgggtcacagagcatcccattcccacacaccgttgtggccacctcaccagcaggggcaggcccatatgcccaggtttgcctggtgaggagctgggggcgggggtatgccccgccccgggagctgacgtcataaaaggagctctggagggcagcccactctggcctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagttttttggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtgagtt

SEQ ID NO: 3034 - DNA, 1197 bp, Homo sapiens
catctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttca

SEQ ID NO: 3035 - DNA, 698 bp, Homo sapiens
cagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgccagaagagcctgtgactacatttctttcaatctctttggctgtttgtttcagtatacacactccctgttattgcttactattttatgagctctaataaatgtacttctcaagttgctcatgaa

SEQ ID NO: 3036 - DNA, 1017 bp, Homo sapiens
agttgtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaattttttttttttttaaga

SEQ ID NO: 3037 - DNA, 2004 bp, Homo sapiens
ggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcaggtcgctgtaacctccgtctcctgggttcaagtgattctccagcctcagcctcccgaatagctgggattacacgtgcccaccaccatgcccagctaatttttgtatttttagtagagatggggttccaccatgttggccaggctggtctcaaactcctgacctcaggtgatccacctgcctcgacctcccaaagtgctaggattacaggtttgagccaccgtgcctggcctaagttttgttaatagagatgggatttcatcatgttggctaggctggtcttgaactcctggcctcaaatgatccgcccacctcaacctcccaaagtgctgggattgcaggcgtgagccaccatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcaagaccaccctggccaacatggtgaaaccccatatctactaaaaataatttttttaaaaattagccagtcacgttggtgtctgcctgtggtcccagctactcgggaggctgaggcacaagaatcacttgaacccaggaggcagagtgagccgaggttgtgccactgcactgcagcctgggctacagagagcaagactctgtctcaaaaaaaataaaataaaataaataaaaaaagatata

SEQ ID NO: 3038 - DNA, 2178 bp, Homo sapiens
cggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtggctcataaacctctctgatgagtcctgccagtgttttcttagatcccactgttgagacaatggagccacagaattctttcacctcttgttgtcagacaaatccaatagaacacaaggtcagaagggcctatacttctaaaggttgaaagattctttttcaaaagatgatctaagaaatgtaggaccagtagatgctcaagtatatcttgaagaaatgtcttggaatgaaggttggattttttttttctcttgacaacatttaaaaaaaaaaggaattttctataagaaaaaaaaactcattggatatttggaaatcttaaaaagaaataatagtgtggctttctatatatatgtggtaagtgtttctgtctggagtatttctgcttaattctaaactttatttattgactgatgtccccctatatgactcatttccagttatttttatattctaattagatgttaggaacataaagtttcataagagtttttttgttgtgtttttttactttagtttttgcattactgtctatgtagtattgtagtatggtaaataatgtcaaacaagatagttttttttttccgttccttttaatgttgacaagatgaattcctattagaatttttattttccctttatataaaatcataaactgtcaggacagggcttttaagaggcttgatttttttttttttttttttaacgctcacatactgattgtcttataagaagaaaagaatatctgccatttcccttgatgcaacatgaagtcatgtcttttttgcttttctgttattaaaattttagaacttaaattcaatgtcgtttccctattcttctgatggttccttgaattgttctggttagacatcattacattgggaaacacactttactaaacagaagccatgagtaccatacttacttgtttctctgggcaaatgaagaaaatcttactatttcctagaatctttatatatgcttaaccttttaaccttattgttcagcatgagtacaaattccctccaggtttataaaaatctactaatgagtgtggataggtagaagacaaaaacagagccatctgaaaccaaatttactttttaaatggcaaattcttaacttagtgcccctaagacgtgggtcacaagcctaacttagaaagggaatcatgtctttgcctctggggccattctgtccccaacccctcaagtgaaatcctagagtagaaattcagtgaataattggaaaagttgaggttttgtgtaactggggctcttggtggtgacagtctcatcagagtaaacacgaagaaatactgtgaaaacaatacactagtgatacagattttcactgctggtgtgtggaagggacactctagaatatgtcatttatcaggaagacttgcccagttaaaaaaaatatatgcacatatgtatatatacacacatatactttttattttttgccaaatacacaaacttcaaggagactaaatatgttttgaaaatatagtttgtctccttatctattggtatgtatatgtatgtttgtatgtgtttaatgtcttaataaattagttcttgctatagtcgatatgggtaatatattttgtttatgactgtgaaaatagtgaaaactggtttttataaatttttttttaccttttaaatatataacaatataatgttaagatcttaattttaaatgagaatacgggctggaagcctggaatcccagcactttgggaggctgagtttggagaatcgcagaggtcaggagtttgagaccagcctgggcaacataggaagactgtgagaacagattgtgagaatagg

SEQ ID NO: 3039 - DNA, 1625 bp, Homo sapiens; identical to SEQ ID NO: 3019

SEQ ID NO: 3040 - DNA, 1354 bp, Homo sapiens; identical to SEQ ID NO: 3020

SEQ ID NO: 3041 - DNA, 1480 bp, Homo sapiens
tcccgaggtgccctgcctgggtcctccggggtaaagttcgtttggcggaagattgtccgttttcctggtaaggtcacctgtcccaatcaggtacgattctgccttccgtacccccgagcccctcagtgtaaagtggcaaatggtctagcccggcggaggcaccagctggaggcggtgggagggacacccgcagtgaagggcggaccgcgcacgcatgcgcagaggcgcggcaggggggcgggagccgcggaacccctaccccaggtctgcgcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttact

SEQ ID NO: 3042 - DNA, 1448 bp, Homo sapiens
agagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtctctcaggcagctgcagagcttcaacagtactgtatgcagaatgcctgcaaggatgccctgctggtgggtgttccagctggaagtaaccccttccgggagcctagatcctgtgctttactctgaagactcgagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatca

SEQ ID NO: 3043 - DNA, 8897 bp, Homo sapiens
gggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagttgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaaaaaaaaaaaaaaggcttcttattagcaaaagtatatgtaatccagtctgttcctaacaagtgtaagcaaaaatgtgagaaggggaacattcagaagcaaaagaaccagtctagctgtcctacacatcatgtcataccctgtctttctggtgagcgtttccttgttgctgacaatgttgctccctgtggccatccatctgagctacgtgaggaggattccatgtgaacgccgatcagcttccatttaaccttgagagaaaagagaggttctaaatgaagaactctttaagaaagaaagaatacacccataaagaactcagctattttgcagtaaagagaagaacaaaatgggtacaggattgtggatatcatagatgctgttctcacacaaccactgggggcttgtaatttactgtgtaaccagaacttgcagggctttattttttcttttactggacacaggttgtctgagattataagaaataaaatagatcaataattttcatcatccctgacactgattacaaacctacagtgtttaaagggaggtagtgaattccacggaaactgagtttggctaattcaggtcaacaaagatatatttgcccttaattctggagttaagtaaaaataaaaattatcctgcctgaatcatctgatgctttgtgcctaagatggttatctctcaaatactctagggtgggtttaaagaacagtgagctcaggtcacgcaagatgaaaacccaggttttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatctatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacatgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccagggtcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaaatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattatttttaaatctgtctgtgtgatttttccccttggtaaaaatacatgaaatacataattgaaaaattaccttcttctgaagtcgtagtttttaatcttaaccatcaataaataaacctattgttaacaatgtcttattcataattctaaaaaatttacaaatgatattgctatgaggttgtgcactattaaagtttgctccatcacttaaaggtaaagcagttcaaaaatactactttacatcacaactttgcatggctgagattttgaacaactaaattgatggttttacccacaagttatttcataaagctaacactgtaatattacttggttttcttatacttttgttatcatgtgatgaaatgtaactatgtaattaaacaaaattctgacaatcatattctgctaatgtttaaaatgttacttattccttcacttattagcttgctattttgaaaataaagtgaaagaaggccctttattaaatgaaa

SEQ ID NO: 3044 - DNA, 1452 bp, Homo sapiens
atggccgaagacacctattcacacaagatggtaaaaacaaatcataggcgctgtcgcacaaaattcacagaagaacagttgaaaatcctcatcaataccttcaatcaaaagccttacccaggttatgctaccaaacaaaaacttgctttagaaatcaatacagaagagtccagaatccagatttggtttcagaatcgaagagctaggcacggattccagaaaagaccagaagctgagactttagaatcaagccagagccaggggcaagatcaacctggtgtggagtttcaaagtagagaagccagacggtgtcgtaccacctacagcgcctctcagttacacactctcatcaaggcatttatgaaaaacccatatcctgggattgattccagagaagaacttgctaaagaaatcggtgttccagagtcaagagtccaaatttggttccaaaatcgaagatctagattacttctccagagaaaaagggaacctgtggcgtccttagaacaagaagagcagggcaagattcctgagggactgcaaggtgcagaagatacacaaaatggcaccaacttcactagtgactctcatttctctggagccagaacgtggtgaacacagtcaaattcagtgtacttgataatatcaactggaccccaaatctgtctcacggtcttcctgggagtctatccttctgctgaaactgcaagctaagccttctgaagatggtaaaggacttggccagatgtggtgggtcacacttgtaatcccactactttgggaggccaaggcaggaagattgcttgagctcaggagtttgaaaccagcctggacaacatatagcaagactctgcctctattataaaaaaacaaaataaatgaaaaggactgtaggaggcagagacgggtacagggggtaccacactaccctgttgacacagcctagatccagagttcagaagaccttgagacaatgaaaataaacttggtaataatcttttttcaatcatcacagtaattattgatttgtacaaaaatcacttgacgtcataaccttaaagtgacactgctctgcctatggagtagccgttcttttattcctttactttcttaacaaatttgctttcacttaaaaaaaaacctttaagttcaaggaagaacaagatatatacttcatctcaaaagaatctactcacacacacttattaattacaaaaggaaaatcagtaattttgcagcagagaaatatggccaactccaccttaaccaagtggctgaaagtcactgcaccagtaatggcacaaaccaatgtgagatgcttcctgatatgatacagtaagaaggccacagtctcttctgcgtgttagtgacaaaaagtgggtaagctgaaactaataattaggcaatgtcaagtgaacacaaattcaggatgacagactgcaaagtaacatc

SEQ ID NO: 3045 - DNA, 3498 bp, Homo sapiens
agatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 3046 - DNA, 3432 bp, Homo sapiens
agatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggcaagggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaaggtgaggaaactgaggctcagagaagttaagcaacctgcttcttccaagggcactaagttagctggcagacccctgataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 3047 - DNA, 3607 bp, Homo sapiens
agatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccaggcaagacacagtcccatttacatttaaaagttttctgtttggccacagtatggagattagaccatggaagaggaaagggagaacattatttaggaggcttttgttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 3048 - DNA, 2683 bp, Homo sapiens
ttcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 3049 - DNA, 3295 bp, Homo sapiens
aacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaa

SEQ ID NO: 3050 - DNA, 2644 bp, Homo sapiens
atgaccataaactctttcaagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 3051 - DNA, 2785 bp, Homo sapiens
atgaccataaactctttcaagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 3052 - DNA, 1349 bp, Homo sapiens
atggcaggtggcagtccagcagccaagagggtagtggtgtaccggaatggggacccattcttcccaggctcccagctggtggtgactcaacgccgcttccccaccatggaggccttcctctgcgaggtgacatcagctgtgcaggccccactggctgtgcgtgccctctacacaccttgtcatggccaccctgtcaccaacctggcagacttgaagaacagagggcagtatgtggccgctggatttgaacgattccacaagctccactatttaccccatagagggaaggacccaggtgggaagagctgcagactacaaggtcctcccgtgactcgccacttgtgtgatggggccattggacggcagctgcctgcaggtgctcccagctatatccatgtgttcaggaatggggacctggtaagtcccccatttagtctgaagctgtcccaggctgccagccaggactgggaaactgtgttgaagctcctgactgagaaggtcaagttgcagagtggggctgtgtgcaaactctgcaccctagaggggctcccactgtcagcagggaaggagctggtaactggccattactatgtggctgtcggagaggatgagttcaaggaccttccctatctggagctgctggtgcccagcccctccctgcccaggggctgctggcaacctccaggctcgaagtctaggccccacaggcagggggcccaaggccacagggcccaggtaacccagccctctccaaaggaaccagaccgaattaagccatctgctttctatgccagaccccagcagaccattcagccaagaagcaagctccccacactctcattcccatcaggagttataggagtatatggagctccccaccgaaggaaggagacagcgggggccctggaagtagcagatgatgaagacactcagacagaggagcccttggatcagagggcagcacagatagtggaagaggccttgtccctggaaaaccagcctggggctggggctgctatctcagcctcagccccagctctgccatcttgagagccagcagctccagagggcaactggggaccactactctggccaccttttgtccttagcctccagcagcttgttcctcaggagccagcacctccgctgggctcacagggtacactgcggcctcctcagccctccccgttctcctgctcctaaacccacagcccagccttcccttcctctgagcagagcagccctggctgtgggggctatttccttatgggattctctggccagagaaaggagtagctgactaagcctgggagagggtttgtcacaataaaagaatacttactaacctc

SEQ ID NO: 3053 - DNA, 450 bp, Homo sapiens
ctaatcctggaagagcagttcccgtcgggtttaattggcccattatttacaatgaatgggcatcttttgggcgactcaaaggatttgcaagacaatcacttttatgttgctgtgggactggagaccttcaaatattttccttactggaagtctccaagggtgcccagtgaggtccaacaaaggtatgcgaatgttgaaaaaaactcacagagaaagaaaaaagtggactccaaaggaaaagaaccttgtaaatatgatggcataccccctaaaacacaggattctgtttattatgccaaagaagaaaagaagaaaacattggcagaacctttagtccaaaggggtgcagaaggtgacgtgtataaagcaccgactcctagcaaggaaacccaaggggcgctggacgtcaaagaggagcacaatgtgcagctggaggtgcctgtggaccag

SEQ ID NO: 3054 - DNA, 1100 bp, Homo sapiens; identical to SEQ ID NO: 3012

SEQ ID NO: 3055 - DNA, 612 bp, Homo sapiens
cgggacgccgctcctgggtggcgagcaggcgcgtgtgtaggggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 3056 - DNA, 750 bp, Homo sapiens
gctcctgggtggcgagcaggcgcgtgtgtagggacgaagtttcactcttgttgcccaggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatgtttttgtttgtttcaaatttcaaa

SEQ ID NO: 3057 - DNA, 1169 bp, Homo sapiens
aacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatgtcagtatcagtgtgttttgtgaaaaaactcgtttttgtttttgtttttgattttttttacttaggtaaagcctagggaaaatgaggctaggccaggattggttggcaaataggccttttgcttcagagaaagaaaatcagttccctggttgcggattatattcctaattggcattctgcccttttgtgaagtgtgtcactggcttatctatatctccgtatctgtgacttcaaaacctcttcaaaatatgtt

SEQ ID NO: 3058 - DNA, 750 bp, Homo sapiens
aacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctctta

SEQ ID NO: 3059 - DNA, 829 bp, Homo sapiens
ggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacc

SEQ ID NO: 3060 - DNA, 1842 bp, Homo sapiens
aaagcggaaggggcgcgcggatagagctcccagtgtgccaagcgtgggcggtatacagtaaacaaagacaacccctattcttatcaccttgcctactgagtgcaagtccaggaactgtgtaagcagaccctcagaggagctctgggaaacactgaaaaatagcctctccccccattggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 3061 - DNA, 2022 bp, Homo sapiens
aagaagtgcctttcgcctcccaccatgattctgagacctccccagcaatgtggaactaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 3062 - DNA, 1736 bp, Homo sapiens
tgctgccaccatgtaagaagtgcctttcgcctcccaccatgattctgagacctccccagcaatgtggaactgctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 3063 - DNA, 2254 bp, Homo sapiens
tgctgccaccatgtaagaagtgcctttcgcctcccaccatgattctgagacctccccagcaatgtggaactaaggagattcctacttaccagttgttccatggtcacattttccttatacttgtaaatccacaatgctaaatattctatcggatccactgggcgaactcttgccacttctgcaagaccttgagttaaacaggccccaaggtgcttttgaagatatattgactccatttctaactcctaaaaagcatcttggctcaacataagaaagccctttcccacagaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 3064 - DNA, 439 bp, Homo sapiens
cgcgcctcaggagccagtgtaggcgccgcaaagcggaaggggcgcgcggataggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttc

SEQ ID NO: 3065 - DNA, 1173 bp, Homo sapiens
aaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtc

SEQ ID NO: 3066 - DNA, 2680 bp, Homo sapiens
gttcgaggactcgcgggtgtgcagggatgcggtttaatattttcatgtgattcctaaaagaatctgaggctcaagaaaagagggcatcttaatatcctgcactttcagtcattgagggcatgatcacaaagatcaaagccatttttaggcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattctggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaacttta

SEQ ID NO: 3067 - DNA, 479 bp, Homo sapiens
gtctggtccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagtttagcctatatcatcttggccagtccatggtctcctcagcatctaaaatcacatgtataggctaa

SEQ ID NO: 3068 - DNA, 1584 bp, Homo sapiens
gctagtaactgcctggctcctccctctggtgtctcccggaaagcgctccgtctggtccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattctggtatcta

SEQ ID NO: 3069 - DNA, 2212 bp, Homo sapiens
atgcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattctggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaacttta

SEQ ID NO: 3070 - DNA, 1131 bp, Homo sapiens
tcgggctcgggcggagctggagacgtgtggagctgttcgaggactcgcgggtgtgcaggtctgagtaccactccgatccctggtggaggtccccgcgcctctctggagaccagtggtctggccccagagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttatttt

SEQ ID NO: 3071 - DNA, 583 bp, Homo sapiens
agacgtgtggagctgttcgaggactcgcgggtgtgcaggtctgagtaccactccgatccctggtggaggtccccgcgcctctctggagaccagtggtctggccccagaggtgcggccgcgggaagtggacattctttgtcaggaccctagcggaggtcgcgctgggtgtcgcctgtgagggggatcctcggtttctgcgcggtctcttgctttttttaggatcttgcgggccctttgggaaaaagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgaca

SEQ ID NO: 3072 - DNA, 2307 bp, Homo sapiens
gcttcaatgccacggcctgaccggagtgtccgccatggagtcgcagaaagaggcacgaacactccaggagcccgttgcgcggccttctggggcctcaagctctcagacgccgaacgacaaggagcggcgggagggcggcgcagtgccggcggcggctgccctgggcgcagaggcggacgacgacagtgcggacgggctgtgggagctgccggtggagccggccgagcggaggcctgagtgcacccgctgcagccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaagagatcctgaactttcaactgtttgccggaagtctggtacattaatattatatccaggggctgaagctgctaatttggaagaatttatattagattctcctgtttatccttctacaatcatcatcattgatggtacatggagccaggctaaggacattttctataagaactccttgttccgacatcccaaacaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaaggagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatac

SEQ ID NO: 3073 - DNA, 3597 bp, Homo sapiens
atgacgcctgagccaaaggccctacctcctgtggccttggttagagacaccgaaggccagctgtgtcttccccagcagagacaaaggtgtgcgcatgggcatagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactga

SEQ ID NO: 3074 - DNA, 4164 bp, Homo sapiens
aggtttcctgttaacagctgtcctgcccctaggagaagaagccctgaggaaggaggtggctggttcctgtctcactggccggagcttcagcttcagtcatttcatctgggtccctcagcccttggtggggaacatccaggcaggttagagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttggcagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgatttttttttttttaatgttttgagtctccattaaaaatggtatgttggcaaat

SEQ ID NO: 3075 - DNA, 4034 bp, Homo sapiens
atggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttggcagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgatttttttttttttaatgttttgagtctccattaaaaatggtatgttggcaaatagttcttctttattctggtcatgtttaactttttgg

SEQ ID NO: 3076 - DNA, 1555 bp, Homo sapiens
tggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 3077 - DNA, 3461 bp, Homo sapiens
acgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaaggctggtctttacccttcttcctcactgtcatatcgagttttcctttgtgtgtgtgtgtgtgaaacatagtgcttttaattttatatttccggctgaggtgatgcacaaattatcttacagacacaaaaagaaatacatttggtaaaacatcgaagacaaattaagaaaaagcaaatagggatcctccattatttacactccagaatcttgagtgtttgggggtgccggcgcattctaccagtctcagggaaggacatgagtacagactacagtaatcagaatctgagtcataggtgaaatcaggaaaagcaactcttcttgtgtttatttttagtagtgtcataagaacggactagttcttcctgcgtgaccacggatgcttctgtttgagaaaatgcatacccacgtgggacatttagatcaagaaagctgttgatgaagacattgttgaagggcaacttgggtgattggggaattattctcttcatcagcccctctgcaatacagctggagctgtcccataggagttcggacaattacggacatcctttttctttctctctttctttttttttgtttgtttgtttgagacagagtctctgttgcccaggctggagtgcagtggcgcaatcccggctcactgcaacctccgcctccctggttcaagtgattctcctgcctcagcctcctgagtagctgggactacaggtgtgtgacaccagacccggctaattttttgtatttttagtagagatggggggtttcaccatgttagccaggatggtctcaaactcctgacctcgtgatccacccacctcagcctcccaaagtgctgggattacaggcgtgagccaccgtgcccagcctcctttttctattactagagaactccaggacattaagaatttcaaaagtgattttttcacccatggcttctacggtgacagagtatggtgttcctgtagggaaacaaagccaagtttttttgctcctttcactaaagctgcttcatccggggaggaagcctggtagattataatatttccagggataacagtgtggcacacagataacagggtaagaaattggtctatatagttttctgtgggatggccattctcaatgttctccaataaactggggtaattaaaatatcagggctcggatggaaggtgttgcaccataaatgacacctgcagtggtacttgttaaatgtcttaacattgcaagtgagggttcccattttatcagaaaatagaaattttacctgcccaagttcttcactgagattgaatgtgctggccatggtgtggacactatttactttataatgcacatcttgatcccagtttataaactgggcctgaatatatttcacaatttccatagtgaccagcagactaatggggatgaggtactgttataagatgatgaacaccagtatgtcaaacacaatgctgtgagctggaatcctctttcaggtaccaaatgtcaccatactttttattccatagcacggctcccacgcagctcactacagacatgaccagagcagcaggaaccaaagggagacccgcccattgtcactttcttaatctctgatctcttgaggtgatttgacagaattctgcaggaatttggtttcaaagccagtgtaaacaactatgccagtgatccactgagcatttcttttttttttttcttgagacggagtctcactctggtgcccaggctggagtgggcgccatcttggctcactgcaagctccgcctcccggcttcatgccattctcgtccttcagcctcctgagtggctgggattacaggcgcccgccaccacgcctagctaatttctttgtatttttggtagagacggggtttcactgtgttagccaggatggtctcaatctcctgacctcatgatcctcccgcctcggcctcccaaagcgctgggattacaggcgtgagccacctcgcccggccaatccactgagcatttctaagctgtgtatctcttaacaagacccagtcaggccctattggaacagggcttttaccacctaggcggaagctcagccattgaaatgacgatcaggtgcttcacggtctatttttccagataggcctaacagctggttttctgtttgcatttcagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 3078 - DNA, 2289 bp, Homo sapiens
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 3079 - DNA, 2218 bp, Homo sapiens
gcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgca

SEQ ID NO: 3080 - DNA, 2168 bp, Homo sapiens
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 3081 - DNA, 2228 bp, Homo sapiens
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 3082 - DNA, 2215 bp, Homo sapiens
agggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 3083 - DNA, 9542 bp, Homo sapiens
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagaatgagagctcgtcactggaaacagatatcagaaattgtaggctatgacttgactccagactctggaactacactgagaaaagttttaaaattaaaccttaccccatacttggaacaatttgaagtgataagtgcaggtgcaagcaaggaattttcattagagaaagccatgaatacaatgataggaacttgggaagatattgcttttcatataagtctgtatcgtgacactggagtctgtattctttcttcggtggatgagattcaggccatccttgatgatcaaattataaaaactcagacaatgagaggctcacctttcatcaaaccatttgaacatgagatcaaggcctgggaggaccgcttgattcgaatacaagaaacaattgatgaatggttaaaagtacaagctcaatggctgtacttagagcccatcttttgttctgaggatatcatgcaacagatgccagaagaagggcgtcaatttcagacagtagacagacactggagagatatcatgaagttttgtgctaaagatccaaaggttcttgctgccacttctttaacaggtttattggaaaaactacagaactgcaatgaacttttggagaaaattatgaaaggtcttaacgcatatcttgaaaagaaacgtcttttcttccctcgttttttcttcttatctaatgatgaaatgttagagattttatcagagaccaaagatccacttagagttcagccacatttaaaaaaatgctttgagggcattgctaaattagagttccttcccaatttggacattaaagccatgtatagctctgagggcgagcgagtggagctgattgcactcatttccacgtctgcagcgcggggtgctgtggaaaagtggctcattcaagtggaagacctaatgctccggagtgttcacgatgtgatcgctgcagccaggctggcttatccagaatctgcaagaagagactgggttcgagagtggcctggccaagttgtactttgtatttctcaaatgttctggacatctgagacacaggaagtgataagtggcgggacggagggattaaagaagtattataaggaacttcagaaccaactgaatgagattgtagagctggtaagaggaaagttgtctaagcagaccaggaccactctgggggctttggttactattgatgtccatgctagagatgtggtcatggacatgattaaaatgggtgtctcacatgatacagatttcctgtggcttgctcagctccgatattattgggaaaatgagaatgcccgagttcgtatcattaattgcaatgtaaaatatgcttatgaatatcttggtaactcacctcgacttgtcattacgcctctaactgacaggtgttacagaacattgataggtgctttctatttaaaccttggaggtgctccagaggggccagcaggcacaggaaaaaccgaaaccaccaaggacttggctaaagctcttgctgtacagtgtgtggtgttcaactgttctgatgggctagattatctagcaatgggaaagttttttaaaggactggcttcttctggtgcttgggcttgctttgatgaattcaatcgaattgagttggaagtgttgtcagtggtagctcaacagatcctttgcattcagagagctattcaacagaagttggttgtgtttgtttttgaagggacagaacttaagctcaatccgaattgttttgtagctattaccatgaatcctggctatgcaggacgctctgaattgccggacaatcttaaggttctttttagaacagtggctatgatggttccaaactatgcgcttatagcagaaatctccctctactcttacggatttttgaatgcaagacctctgtctgtgaaaatagtaatgacctataggctttgctcagagcagctctcatcgcaatttcattacgactatggaatgcgagcagtaaaagccgttttagtggctgctggcaatctaaaactaaaatacccaaatgaaaatgaagatatacttcttcttcgatcaattaaagatgtaaatgaaccaaagtttttatcacatgatatacctttatttaatggaataactagtgacttatttcctggtattaaacttcctgaagctgactatcacgaatttttggaatgtgctcatgaagcctgcaatgtacataatcttcagcctgttaaattttttcttgaaaaaataattcaaacatatgaaatgatgattgttagacatggttttatgttagtaggagagccttttgctgctaagacaaaagttctgcatgtgctggcggatacgctaactttaatgaatgaacatggctatggagaggaagaaaaggtcatttatagaactgtaaaccccaaatctattactatgggccaactttttggacagtttgacccagtgtctcatgagtggactgatggtattgtggctaacacttttagagaatttgccttatcagaaacacctgaccggaaatgggttgtatttgatggtcctattgacactttgtggatagagagcatgaacacagtattggatgataataaaaagctttgccttatgagtggagaaatcattcagatgtccccccaaatgagcctcatctttgaaacaatggacctttcccaggcatcccctgccactgtaagtcgttgtggtatgatttatttggagccttcacagttaggatgggaaccacttgtgtcttcttggttgaattcactgaaaggacctctgtgtgaaccagaatatcaagctcttctgagaggactttttgcctggttaataccaccctctttaaaccagcgggttgaattattccagctaaactatttgtatacaaccatagtgtctaaaattttaaaaattctaattactttccgtatttcaaattattttaaatatgtgcctctaaaaactcaatgtacatttattaaattttttctccaccaacaggcttgctttatattctctttgatttggtcgattggaggaagttgtgatacagatggccgtcgtgtttttgatactttcatacgattaatcatactgggaaaagatgatgaaaacccagtgccagattctgtgggtaaatgggaatgcccatttgatgaaaaaggcctggtctatgactacatgtatgagttgaaaaacaaaggtcgctgggtccattggaatgaattaattaaaaatactaatttaggagataaacaaatcaagattcaagatatcatagtccctacgatggacacaattagatatacgtttctaatggatttgagtattacctatgcaaagccactcctttttgtgggtccaacgggtacaggaaaatctgtgtatgtgaaggataagctaatgaatcacttggaaaaggaccagtactttcctttttatattaacttatctgcacggaccagcgccaatcaggttcagaacattatcatggctagattggataaaagacgcaaaggagtctttggaccacctatgggaaagaagtgtataatttttatagatgatatgaatatgcctgcattggagaagtatggagctcaaccacctattgaattattacgacagttttttgactgtggacattggtacgaccttaaggacacaagtaaaatcacgctggtggacatagagctgattgctgcaatgggccctccaggtggtggaagaaatccagttactccccgttgtattcgacatttcaacatctgcagtattaattcttttagtgatgaaactatggtccgaatcttctcatctattgtagcattctaccttagaactcatgaatttcctccagagtactttgtaattgggaaccagatagtcaatgggactatggagatatataaacaatctgtggaaaatcttttacccactcccacaaaatcccattatactttcaacttgcgtgatttttcacgcgtcatccggggctgtttactcattgaaagagacgccgtggcgaacaaacacactatgatccgtctgtttgtgcatgaggttctccgagtgttttatgatcgcctcattaatgatgatgatcgaagatggctgttccagttaactaaaactgttataaaggaccattttaaagaatcatttcacagtatcttttcacatttgaggaaacaaaatgcaccagtaactgaagaagacttaagaaatctcatgtttggtgattatatgaatcctgaccttgaaggagatgatagagtttatattgaaattccaaatattcatcattttagtgatgttgtggaccagtgcttagatgagtataatcaaacacacaaaacaagaatgaatcttgtcatttttaggtatgttttggaacatttatcaagaatatgtcgagttctaaagcaatctggtggaaatgctttgcttgttggtcttggaggaagtggtcgtcaatctttaactcgtctggctacatccatggcaaaaatgcatattttccaaccagaaatttctaagagctatggtatgaatgaatggagagaggatatgaagagctttattgctgtcccggtgaccaacaggatagtggataacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaaccaag

SEQ ID NO: 3084 - DNA, 13708 bp, Homo sapiens
gtggcagttggagcccctcgagggaagggagccattttctttcctggtttgggaaagagttgctcatcagtttgcgggagaagctgtttgccttcagctgatacacagtgtaaggaaaggccaagatgacaatggccccggacgtcagactagagtatctggaggaagttgcctccatcgtcctgaagttcaagccggacaagtggagcaagctgataggcgccgaggagaacgtggccctgttcacagagttctttgaaaagcccgacgtccaggtgctggtgctgacgctcaatgcagccggcatgatcataccctgcctgggcttcccccagtccctcaagtccaaaggggtttacttcatcaagacaaagtccgagaacatcaacaaggacaactacagggcccggctcctttacggcgacatcagccccacacccgtggaccagctgatcgcggtggtggaggaggtcctctcttctctgttaaaccaaagtgagaacatggctggatggccccaggtggtctcggaagacatcgtgaagcaggtccacaggctgaagaatgaaatgtttgtgatgagtggcaagatcaaaggcaaaaccttgctgcctattccggagcacctgggcagcctggatggcacgctggagtccatggagaggatcccctcttcactggacaacttgctcctgcacgccattgaaaccaccatcatcgactggtcccaccagatccgggatgtgctgagcaaagactcagcccaggcgctgctggatgggctgcaccccctgccccaagtggagttcgagttctgggacactcggctgctgaacctcaagtgcatccatgaacagctaaacagacccaaagtgaacaagattgttgagatcctagagaaagccaaaagctgctactggccagccctgcaaaacgtttacaccaacgtcactgaagggctgaaggaagccaacgacatcgtgctctatttgaagcccctacggatcctgctggaggagatggaacaagccgacttcacgatgctccccaccttcattgccaaggtgctggacaccatctgcttcatctgggccacctctgagtactataacacacctgccaggatcatcgtcatcctgcaggagttctgcaaccaaatcatcgagatgacacgaaccttcctgagcccggaagaggtgctgaagggcctgcaaggtgaaatcgaggaagtcctgagtggcatctccctggctgtaaatgtgctgaaggagctctaccagacgtacgacttctgctgcgtgaacatgaagcttttctttaaggacaaagagcccgtgccttgggaattcccttcttctcttgccttttccaggataaattccttcttccagcgcatccagaccattgaggaactctataaaacagcaattgagtttctgaagctggagaaaatcgagcttgggggcgtgcgtgggaacctcctcgggagcctggtgacccgtatctatgatgaggtctttgagctggtgaaggtttttgccgactgcaaatatgatcccttggaccctggagactcgaattttgaccgtgattatgctgattttgagatcaaaatccaagacctggataggaggctggccacgatcttttgccaaggatttgatgactgcagctgtatcaagtcctccgcaaagctcctgtacatgtgtgggggcctcatggagcggcccctgattcttgccgaggtggcgcccaggtattcagtcatgctggagctgtttgacgctgagctagacaatgctaagatcttgtacgatgcccagatggcggcctccgaggaggggaacatccccctgatccacaaaaacatgcctcccgtggccgggcagctcaaatggagcctggagctgcaggagaggctagaggtgtccatgaaacacctgaagcacgtcgaacacccggtcatgtctggagcagaggccaagctgacctatcagaagtatgacgagatgatggagctgctgaggtgccaccgcgagaagatctaccagcagtgggtggcgggcgtggaccaggactgccactttaacctggggcagccgctgattctgcgggacgccgctagcaacctcatccacgtcaacttcagcaaagcgttggtggcagttctgagagaagtcaagtatttgaatttccagcaacagaaagagattccagacagtgcggagagtctgttctcagagaacgaaactttccggaagtttgtgggcaacctggagctcatcgttggctggtataatgagataaagactatagtgaaggcagtagaatttctactaataaagtcagaactggaagcaattgatgtcaagttattgagcgctgaaacgacattattctggaatggcgaaggtgtgtttcagtacattcaagaggtgcgagaaattctgcacaacttgcagaacaggatgcaaaaggcaaaacaaaatatagaaggaatttcccaggctatgaaggactggtcggccaacccgctgtttgaaagaaaggacaataagaaagaggccctgttagacttggatggaagaattgccaacctcaacaagcgctacgcagcagtcagggatgctggagtgaagatccaagccatggttgcagaaaacgcagaactattcagggcagacacactgagcctgccctggaaggattatgtcatctacattgacgacatggtcttagatgaatttgaccagttcattcgcaaatctctgagtttcctaatggacaacatggagagtatcgctcccctgtttgagatccgcatggagctggacgaggatgggctgaccttcaacccgaccctggaggtgggctcagatcgcggcttcctggcactgatcgagggcctggtcaacgacatctacaacgtagccaggctcatccctcggctggccaaggacaggatgaactacaagatggacctggaagataacacagacctcatagagatgagggaggaggtgtccagcctggtcatcaatgccatgaaggaggccgaggagtaccaggattcctttgagaggtactcctacctctggacggacaacctgcaggagtttatgaagaatttcctgatatatgggtgtgcagtcactgcggaggacttggacacctggacagatgacaccatccccaagacaccgcccaccctggctcagttccaggagcagatcgactcctacgagaagctgtatgaggaggtgtccaagtgcgagaacaccaaggtgttccacggctggctgcagtgcgactgccgccccttcaagcaggccctgctcagcacaatccggcgctggggcttcatgttcaagcggcacctgagcaaccacgtcaccaacagcctggctgacctggaagccttcatgaaagtcgccagaatgggcttgaccaagcccctcaaggagggggactatgatgggcttgtggaggtgatggggcacctgatgaaagtcaaggagaggcaagcagccaccgacaacatgtttgagcccctgaagcaaaccatcgagctgctcaagacctacggggaggagatgccagaggagatccacttgaagctgcaggagctgccggagcactgggcaaataccaagaaactggccattcaggtgaagctgaccgtggcaccactccaggccaacgaggtcagcatcctgcggcggaaatgccagcaattcgagctcaagcaacatgagttcagggagaggttcaggcgcgaggccccgttctccttcagcgaccccaacccctacaagtccctgaataagcaacaaaagagcatctccgccatggaaggcatcatggaggcgctgtccaagtccgggggcctgttcgaggtccccgtcccagactacaagcagctcaaggcctgccaccgggaggtccgcctactgaaggagctctgggacatggttgttgtggtaaataccagcatcgaggactggaagaccaccaagtggaaagatatcaacgttgagcagatggacatagattgtaagaagtttgccaaggacatgaggtctttggacaaggagatgaaaacctgggatgccttcgtggggctcgacaacaccgtgaaaaacgtgatcacgtccctgcgtgccgtgagcgagctgcagaaccctgccattcgggaacgccactggcagcagctcatgcaggccacccaggtgaaatttaaaatgtcagaagagacgaccctggcagatttactgcagctgaacctccacagttacgaggatgaggtccgcaacatcgtggacaaggccgtgaaggagtcgggcatggaaaaggtgctgaaagccctggacagtacctggagcatgatggaattccagcacgagccgcacccgcggacaggcaccatgatgctcaagtccagcgaggtgctggtggagacgctggaggacaaccaggtgcagctgcagaacctgatgatgtccaagtacctggcccacttcctgaaggaggtgacaagctggcagcagaagctgtccacggcggactccgtcatctccatctggtttgaggtccagcgaacctggagccacctggagagcatcttcatcggctccgaagacatccgcacccagctcccgggggactcccagcgctttgacgacatcaaccaggaattcaaggccttgatggaagatgcagtgaaaacacccaacgtggtggaagccaccagcaaacccggcctctacaataaactggaggccctgaagaagagcttggccatctgtgaaaaggctttggcagagtatttagagacgaaaagactggctttcccccggttctattttgtctcctcggctgacctcctggacattctctccaatggcaatgaccccgtggaggtgagccgccacctgtccaaactcttcgatagcctgtgtaaactgaagttccggctcgatgccagtgacaaacctctcaaggtgggcctgggaatgtacagcaaggaggacgagtacatggtttttgatcaggaatgcgacctctcggggcaggtggaagtgtggctgaatcgagtgctggaccgaatgtgctctaccctccggcacgaaatcccagaggccgtggtgacctacgaagagaagccgagggagcagtggatcctggactacccagcccaggtggccctgacttgcacccagatctggtggacgaccgaggtgggcctggcatttgccaggctggaggaaggctatgaaaacgctatcagagattataacaaaaagcagattagccagctgaacgtactcatcacgctgctcatggggaacctcaacgctggcgacaggatgaagatcatgaccatctgcaccatcgatgtgcacgcacgggacgtggtggccaaaatgatcgtggtggagagttctcaggccttcacctggcaggcccagctccggcatcgctgggacgaagagaagcgacactgctttgccaacatctgcgatgcccaaatccagtattcctatgagtatctgggcaacacgccgcggctggtcatcaccccactcactgacaggtgctatatcaccctgacccagtccctccatctcatcatgggtggagcccctgccggccccgctgggaccggcaagactgagacgaccaaggacctgggcagagccctgggcaccatggtctacgtcttcaactgctccgagcagatggactacaagtcctgtggaaatatctacaagggcctggcccagacgggagcctggggctgctttgacgagtttaatcgcatctcagtggaagtcttgtctgtgattgccgtgcaggtaaaatgtgtccaggatgcaattcgggccaagaaaaaagcattcaatttcctgggagagatcataggcctcattcccaccgtcggtatcttcatcaccatgaaccctgggtacgccggacgcgcggagctgcctgagaacctaaaagccttattcaggccctgtgccatggtcgtccccgacttcgaactgatatgtgagatcatgctcatggccgagggctttctggaagcccgccttctggccaggaagttcatcaccctgtacaccttgtgcaaggagctgctctcgaagcaggatcattacgactggggcctgagagccatcaagtctgtgctggtggtggccggctccctgaagaggggcgaccccagccgggcagaggaccaggtgctcatgcgggcgctgagagacttcaacatccccaagattgtgacagacgacctgcccgtattcatgggactgatcggggacctcttcccggctctggacgtgcctcggaaacgggacctgaattttgaaaagatcatcaagcagagcatcgtggagctcaagctgcaggcggaggacagcttcgtgctgaaggtggtgcagctggaggagctgctgcaggtccgccactccgtgttcatcgtcgggaatgcgggcagcggcaaatctcaggtcctcaaatccctcaacaagacctatcagaacctgaagaggaagccggtcgccgtggacctggaccccaaggccgtcacctgcgacgagctctttggcatcatcaacccagtgaccagggaatggaaagatggcctgttctccaccatcatgcgagacctggccaacatcacccatgacggccccaagtggatcatccttgacggagacatagaccccatgtggatcgagtctctcaacacagtcatggatgacaacaaggtcctcaccctggccagcaacgagcggatccccctgaaccgcaccatgaggctggtgttcgaaatcagccacctgaggacggccaccccagccaccgtttccagagccggcatcctctacatcaacccagccgacctgggatggaacccggtggtgagcagctggatcgagaggcgcaaggtgcagtcggagaaggccaacctgatgatcctctttgacaagtacctgcccacgtgcctggacaagttgcgctttgggttcaagaagatcacgccagtgccggagatcacggtgatccaaacgattctgtacctgctggagtgcctgctcacggagaagaccgtgccccccgactcccccagggagctgtacgagctgtacttcgtgttcacctgcttctgggccttcggtggcgccatgttccaggaccagcttgtggattatcgagtggagttcagtaaatggtggatcaacgaattcaagactatcaagttcccctcgcagggaacgatttttgactactacattgatcctgacacaaaaaagttcctgccctggacagataaagtgccctcctttgagctggatcccgatgtcccactgcaggcctctttggtccacaccacggaaaccatccgcatccgctacttcatggacctgctcatggagaagtcctggccggtgatgctggtggggaacgcggggacgggcaagtcggtgctgatgggggacaagctggaaagcctgaacacggacaactacctggtgcaggctgtgcccttcaacttctacacgacctcagccatgctgcagggggtgctggagaagccgctggagaagaaatcggggaggaactacgggccgccaggcactaagaagctcgtctacttcatcgacgacatgaacatgcccgaggtggacaagtatgggacggtggccccgcacaccctcatccggcagcacatggaccaccggcactggtatgacagacataagctgacgttaaaagatatccataattgtcagtacgtggcctgcatgaaccccacttccggatccttcaccatcgactccaggcttcagcgccatttctgcgtgtttgctgtgagcttccccggccaggaggccctcaccaccatctacaacacaatcctgacgcagcacctggccttccgctcggtctccatggctatccagaggataagcagccagctggtggccgcggccctggctttgcatcagaaaatcacggcaacatttcttcccacggccattaagtttcattatgtcttcaacctcagggacctctccaatattttccagggactcttattttccacagcagaagttctgaaaaccccactggacctcgtccgcctttggctacatgagactgaacgagtgtatggtgacaaaatggttgacgaaaaagaccaggaaacattgcatagagtcaccatggcctccaccaagaagttctttgatgatcttggtgatgaactcttatttgccaagccaaatatcttctgccactttgctcaagggattggcgatcccaaatatgttcctgtaaccgacatggctcctctgaacaagctcctcgtggacgtcctggacagctacaatgaagttaatgcagtcatgaatttggtgctgtttgaggacgccgtggctcacatctgcaggattaatcgcatcctggagtctccccgggggaatgccctgctggtgggggtgggcggcagtggcaaacagagcctctcccgcctggcagcgtacatcagcgggcttgacgtgtttcagatcaccctcaagaagggctacgggatccccgacctcaagattgacctcgctgctcagtacataaaggctgccgtgaagaacgttccctcggtgttcctgatgacagactcccaggtggccgaggagcagtttctggtgctgatcaatgacctgctggcctcaggagagatccctgggctgtttatggaggacgaggtggagaacatcatctcctccatgcgaccccaagtcaagtcccttggcatgaatgacactcgggaaacatgttggaagttcttcatcgaaaaagtgcgcagacagctcaaggtgatcctgtgtttctcccctgtgggctccgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcactacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactca

SEQ ID NO: 3085 - DNA, 13792 bp, Homo sapiens
gtggcagttggagcccctcgagggaagggagccattttctttcctggtttgggaaagagttgctcatcagtttgcgggagaagctgtttgccttcagctgatacacagtgtaaggaaaggccaagatgacaatggccccggacgtcagactagagtatctggaggaagttgcctccatcgtcctgaagttcaagccggacaagtggagcaagctgataggcgccgaggagaacgtggccctgttcacagagttctttgaaaagcccgacgtccaggtgctggtgctgacgctcaatgcagccggcatgatcataccctgcctgggcttcccccagtccctcaagtccaaaggggtttacttcatcaagacaaagtccgagaacatcaacaaggacaactacagggcccggctcctttacggcgacatcagccccacacccgtggaccagctgatcgcggtggtggaggaggtcctctcttctctgttaaaccaaagtgagaacatggctggatggccccaggtggtctcggaagacatcgtgaagcaggtccacaggctgaagaatgaaatgtttgtgatgagtggcaagatcaaaggcaaaaccttgctgcctattccggagcacctgggcagcctggatggcacgctggagtccatggagaggatcccctcttcactggacaacttgctcctgcacgccattgaaaccaccatcatcgactggtcccaccagatccgggatgtgctgagcaaagactcagcccaggcgctgctggatgggctgcaccccctgccccaagtggagttcgagttctgggacactcggctgctgaacctcaagtgcatccatgaacagctaaacagacccaaagtgaacaagattgttgagatcctagagaaagccaaaagctgctactggccagccctgcaaaacgtttacaccaacgtcactgaagggctgaaggaagccaacgacatcgtgctctatttgaagcccctacggatcctgctggaggagatggaacaagccgacttcacgatgctccccaccttcattgccaaggtgctggacaccatctgcttcatctgggccacctctgagtactataacacacctgccaggatcatcgtcatcctgcaggagttctgcaaccaaatcatcgagatgacacgaaccttcctgagcccggaagaggtgctgaagggcctgcaaggtgaaatcgaggaagtcctgagtggcatctccctggctgtaaatgtgctgaaggagctctaccagacgtacgacttctgctgcgtgaacatgaagcttttctttaaggacaaagagcccgtgccttgggaattcccttcttctcttgccttttccaggataaattccttcttccagcgcatccagaccattgaggaactctataaaacagcaattgagtttctgaagctggagaaaatcgagcttgggggcgtgcgtgggaacctcctcgggagcctggtgacccgtatctatgatgaggtctttgagctggtgaaggtttttgccgactgcaaatatgatcccttggaccctggagactcgaattttgaccgtgattatgctgattttgagatcaaaatccaagacctggataggaggctggccacgatcttttgccaaggatttgatgactgcagctgtatcaagtcctccgcaaagctcctgtacatgtgtgggggcctcatggagcggcccctgattcttgccgaggtggcgcccaggtattcagtcatgctggagctgtttgacgctgagctagacaatgctaagatcttgtacgatgcccagatggcggcctccgaggaggggaacatccccctgatccacaaaaacatgcctcccgtggccgggcagctcaaatggagcctggagctgcaggagaggctagaggtgtccatgaaacacctgaagcacgtcgaacacccggtcatgtctggagcagaggccaagctgacctatcagaagtatgacgagatgatggagctgctgaggtgccaccgcgagaagatctaccagcagtgggtggcgggcgtggaccaggactgccactttaacctggggcagccgctgattctgcgggacgccgctagcaacctcatccacgtcaacttcagcaaagcgttggtggcagttctgagagaagtcaagtatttgaatttccagcaacagaaagagattccagacagtgcggagagtctgttctcagagaacgaaactttccggaagtttgtgggcaacctggagctcatcgttggctggtataatgagataaagactatagtgaaggcagtagaatttctactaataaagtcagaactggaagcaattgatgtcaagttattgagcgctgaaacgacattattctggaatggcgaaggtgtgtttcagtacattcaagaggtgcgagaaattctgcacaacttgcagaacaggatgcaaaaggcaaaacaaaatatagaaggaatttcccaggctatgaaggactggtcggccaacccgctgtttgaaagaaaggacaataagaaagaggccctgttagacttggatggaagaattgccaacctcaacaagcgctacgcagcagtcagggatgctggagtgaagatccaagccatggttgcagaaaacgcagaactattcagggcagacacactgagcctgccctggaaggattatgtcatctacattgacgacatggtcttagatgaatttgaccagttcattcgcaaatctctgagtttcctaatggacaacatggttatagatgagagtatcgctcccctgtttgagatccgcatggagctggacgaggatgggctgaccttcaacccgaccctggaggtgggctcagatcgcggcttcctggcactgatcgagggcctggtcaacgacatctacaacgtagccaggctcatccctcggctggccaaggacaggatgaactacaagatggacctggaagataacacagacctcatagagatgagggaggaggtgtccagcctggtcatcaatgccatgaaggaggccgaggagtaccaggattcctttgagaggtactcctacctctggacggacaacctgcaggagtttatgaagaatttcctgatatatgggtgtgcagtcactgcggaggacttggacacctggacagatgacaccatccccaagacaccgcccaccctggctcagttccaggagcagatcgactcctacgagaagctgtatgaggaggtgtccaagtgcgagaacaccaaggtgttccacggctggctgcagtgcgactgccgccccttcaagcaggccctgctcagcacaatccggcgctggggcttcatgttcaagcggcacctgagcaaccacgtcaccaacagcctggctgacctggaagccttcatgaaagtcgccagaatgggcttgaccaagcccctcaaggagggggactatgatgggcttgtggaggtgatggggcacctgatgaaagtcaaggagaggcaagcagccaccgacaacatgtttgagcccctgaagcaaaccatcgagctgctcaagacctacggggaggagatgccagaggagatccacttgaagctgcaggagctgccggagcactgggcaaataccaagaaactggccattcaggtgaagctgaccgtggcaccactccaggccaacgaggtcagcatcctgcggcggaaatgccagcaattcgagctcaagcaacatgagttcagggagaggttcaggcgcgaggccccgttctccttcagcgaccccaacccctacaagtccctgaataaggtatttttgctcaagggcatcatggaggcgctgtccaagtccgggggcctgttcgaggtccccgtcccagactacaagcagctcaaggcctgccaccgggaggtccgcctactgaaggagctctgggacatggttgttgtggtaaataccagcatcgaggactggaagaccaccaagtggaaagatatcaacgttgagcagatggacatagattgtaagaagtttgccaaggacatgaggtctttggacaaggagatgaaaacctgggatgccttcgtggggctcgacaacaccgtgaaaaacgtgatcacgtccctgcgtgccgtgagcgagctgcagaaccctgccattcgggaacgccactggcagcagctcatgcaggccacccaggtgaaatttaaaatgtcagaagagacgaccctggcagatttactgcagctgaacctccacagttacgaggatgaggtccgcaacatcgtggacaaggccgtgaaggagtcgggcatggaaaaggtgctgaaagccctggacagtacctggagcatgatggaattccagcacgagccgcacccgcggacaggcaccatgatgctcaagtccagcgaggtgctggtggagacgctggaggacaaccaggtgcagctgcagaacctgatgatgtccaagtacctggcccacttcctgaaggaggtgacaagctggcagcagaagctgtccacggcggactccgtcatctccatctggtttgaggtccagcgaacctggagccacctggagagcatcttcatcggctccgaagacatccgcacccagctcccgggggactcccagcgctttgacgacatcaaccaggaattcaaggccttgatggaagatgcagtgaaaacacccaacgtggtggaagccaccagcaaacccggcctctacaataaactggaggccctgaagaagagcttggccatctgtgaaaaggctttggcagagtatttagagacgaaaagactggctttcccccggttctattttgtctcctcggctgacctcctggacattctctccaatggcaatgaccccgtggaggtgagccgccacctgtccaaactcttcgatagcctgtgtaaactgaagttccggctcgatgccagtgacaaacctctcaaggtgggcctgggaatgtacagcaaggaggacgagtacatggtttttgatcaggaatgcgacctctcggggcaggtggaagtgtggctgaatcgagtgctggaccgaatgtgctctaccctccggcacgaaatcccagaggccgtggtgacctacgaagagaagccgagggagcagtggatcctggactacccagcccagatctggtggacgaccgaggtgggcctggcatttgccaggctggaggaaggctatgaaaacgctatcagagattataacaaaaagcagattagccagctgaacgtactcatcacgctgctcatggggaacctcaacgctggcgacaggatgaagatcatgaccatctgcaccatcgatgtgcacgcacgggacgtggtggccaaaatgatcgtggagagttctcaggccttcacctggcaggcccagctccggcatcgctgggacgaagagaagcgacactgctttgccaacatctgcgatgcccaaatccagtattcctatgagtatctgggcaacacgccgcggctggtcatcaccccactcactgacaggtgctatatcaccctgacccagtccctccatctcatcatgggtggagcccctgccggccccgctgggaccggcaagactgagacgaccaaggacctgggcagagccctgggcaccatggtctacgtcttcaactgctccgagcagatggactacaagtcctgtggaaatatctacaagggcctggcccagacgggagcctggggctgctttgacgagtttaatcgcatctcagtggaagtcttgtctgtgattgccgtgcaggtaaaatgtgtccaggatgcaattcgggccaagaaaaaagcattcaatttcctgggagagatcataggcctcattcccaccgtcggtatcttcatcaccatgaaccctgggtacgccggacgcgcggagctgcctgagaacctaaaagccttattcaggccctgtgccatggtcgtccccgacttcgaactgatatgtgagatcatgctcatggccgagggctttctggaagcccgccttctggccaggaagttcatcaccctgtacaccttgtgcaaggagctgctctcgaagcaggatcattacgactggggcctgagagccatcaagtctgtgctggtggtggccggctccctgaagaggggcgaccccagccgggcagaggaccaggtgctcatgcgggcgctgagagacttcaacatccccaagattgtgacagacgacctgcccgtattcatgggactgatcggggacctcttcccggctctggacgtgcctcggaaacgggacctgaattttgaaaagatcatcaagcagagcatcgtggagctcaagctgcaggcggaggacagcttcgtgctgaaggtggtgcagctggaggagctgctgcaggtccgccactccgtgttcatcgtcgggaatgcgggcagcggcaaatctcaggtcctcaaatccctcaacaagacctatcagaacctgaagaggaagccggtcgccgtggacctggaccccaaggccgtcacctgcgacgagctctttggcatcatcaacccagtgaccagggaatggaaagatggcctgttctccaccatcatgcgagacctggccaacatcacccatgacggccccaagtggatcatccttgacggagacatagaccccatgtggatcgagtctctcaacacagtcatggatgacaacaaggtcctcaccctggccagcaacgagcggatccccctgaaccgcaccatgaggctggtgttcgaaatcagccacctgaggacggccaccccagccaccgtttccagagccggcatcctctacatcaacccagccgacctgggatggaacccggtggtgagcagctggatcgagaggcgcaaggtgcagtcggagaaggccaacctgatgatcctctttgacaagtacctgcccacgtgcctggacaagttgcgctttgggttcaagaagatcacgccagtgccggagatcacggtgatccaaacgattctgtacctgctggagtgcctgctcacggagaagaccgtgccccccgactcccccagggagctgtacgagctgtacttcgtgttcacctgcttctgggccttcggtggcgccatgttccaggaccagcttgtggattatcgagtggagttcagtaaatggtggatcaacgaattcaagactatcaagttcccctcgcagggaacgatttttgactactacattgatcctgacacaaaaaagttcctgccctggacagataaagtgccctcctttgagctggatcccgatgtcccactgcaggcctctttggtccacaccacggaaaccatccgcatccgctacttcatggacctgctcatggagaagtcctggccggtgatgctggtggggaacgcggggacgggcaagtcggtgctgatgggggacaagctggaaagcctgaacacggacaactacctggtgcaggctgtgcccttcaacttctacacgacctcagccatgctgcagggggtgctggagaagccgctggagaagaaatcggggaggaactacgggccgccaggcactaagaagctcgtctacttcatcgacgacatgaacatgcccgaggtggacaagtatgggacggtggccccgcacaccctcatccggcagcacatggaccaccggcactggtatgacagacataagctgacgttaaaagatatccataattgtcagtacgtggcctgcatgaaccccacttccggatccttcaccatcgactccaggcttcagcgccatttctgcgtgtttgctgtgagcttccccggccaggaggccctcaccaccatctacaacacaatcctgacgcagcacctggccttccgctcggtctccatggctatccagaggataagcagccagctggtggccgcggccctggctttgcatcagaaaatcacggcaacatttcttcccacggccattaagtttcattatgtcttcaacctcagggacctctccaatattttccagggactcttattttccacagcagaagttctgaaaaccccactggacctcgtccgcctttggctacatgagactgaacgagtgtatggtgacaaaatggttgacgaaaaagaccaggaaacattgcatagagtcaccatggcctccaccaagaagttctttgatgatcttggtgatgaactcttatttgccaagccaaatatcttctgccactttgctcaagggattggcgatcccaaatatgttcctgtaaccgacatggctcctctgaacaagctcctcgtggacgtcctggacagctacaatgaagttaatgcagtcatgaatttggtgctgtttgaggacgccgtggctcacatctgcaggattaatcgcatcctggagtctccccgggggaatgccctgctggtgggggtgggcggcagtggcaaacagagcctctcccgcctggcagcgtacatcagcgggcttgacgtgtttcagatcaccctcaagaagggctacgggatccccgacctcaagattgacctcgctgctcagtacataaaggctgccgtgaagaacgttccctcggtgttcctgatgacagactcccaggtggccgaggagcagtttctggtgctgatcaatgacctgctggcctcaggagagatccctgggctgtttatggaggacgaggtggagaacatcatctcctccatgcgaccccaagtcaagtcccttggcatgaatgacactcgggaaacatgttggaagttcttcatcgaaaaagtgcgcagacagctcaaggtgatcctgtgtttctcccctgtgggctccgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcaggtacgagggggccagcactgcaggaatatccacctggtggcccggtggctgggaacactggacaagaagctggagcactacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggcaggatctttgaaactgctcccaagcgagaggaagggggaggatctagaactgaggagggggggctgtccggggactggcttccaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactca

SEQ ID NO: 3086 - DNA, 2577 bp, Homo sapiens
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 3087 - DNA, 14716 bp, Homo sapiens
gagtttgagctgagccgaagcgaggaggctttcgactgagggctagcgaggggagcagggctggagcagggctggagcagggctggagcagggctgaagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacaggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttc

SEQ ID NO: 3088 - DNA, 3218 bp, Homo sapiens
aaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 3089 - DNA, 3174 bp, Homo sapiens
cgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcattcgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 3090 - DNA, 2781 bp, Homo sapiens
atggcgacgtctctgcatgagggacccacgaaccagctggatctgctcattcgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 3091 - DNA, 3254 bp, Homo sapiens
aaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 3092 - DNA, 3515 bp, Homo sapiens
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 3093 - DNA, 1835 bp, Homo sapiens
attttaaggaattaccatatttttccattttaggacctcagaatttaagatataagtatatataatgaaatcctttaaacattatcttccgtctattgggtgtaatcagtagaaagcgattagaaaatttttttaaatctgtttttagaggcagtaatgttcttttttctttcttttttcctgtgacagggtttcactctgtcgcccaggctgggcgacagagcaagactccgtctccaaaaaaaaaaaaagtagaaacaagtatattcaggatttttatgatacaatgaaggacactttatttgcttttaattatgtatttaattatgttaatgaattttaatcaatgtctgtcattgtttttaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagactt

SEQ ID NO: 3094 - DNA, 3812 bp, Homo sapiens
ctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctatccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtc

SEQ ID NO: 3095 - DNA, 3734 bp, Homo sapiens
agctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggagagcgctgctctggctgataggttaatccaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctatccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtc

SEQ ID NO: 3096 - DNA, 12633 bp, Homo sapiens
caaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaattta

SEQ ID NO: 3097 - DNA, 4348 bp, Homo sapiens
ccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggtaaggaagcgcctttctaacactgttgttctaaataggcctcagacatctgtacctacttacaggttgtgatatacttcagtaggtttttcgacttaggatctaggttctccagaaagattaatgg

SEQ ID NO: 3098 - DNA, 6381 bp, Homo sapiens
actactccagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaattt

SEQ ID NO: 3099 - DNA, 2051 bp, Homo sapiens
ggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaagcccccctctgtcctggcacccagtgttcctccatcctgactccacgtattgcccccttgccactgcctgagtgcaccatagtgtccccatccccccactgcctggagttccccttgtgtacccccttatcagggcacgacctaactgtgccctgctggctgtgacctcctgaagacagacctggcttctccctgcatccagttccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaa

SEQ ID NO: 3100 - DNA, 2286 bp, Homo sapiens
cgttgccttggctacaccgtctgttagggccgcgcacgagatcagtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgacaatgtgctatcagccctcactcggtcccggcacctcctcggcctcgaagtccactctgtccgcgcttgaggagcccttcagcctgccactgcactgtgggatcccctctctgggcaggcctaggccagagccggctccctctgcttgtggggaggtgtggatggagaggcgcaggctggaaccggggctgcacgtggtgcttatgggccagcacgagttctgggtgggcgccggctcggcaggccccgcacttggagcggccggctggcctgcgggtgccgccggccccaggcagtgaggggcttagcacccgggccaacagctgcgtagggtgcgctgggtcccccagcactgccggcccgcccaagcagtgctagaattctcactgggcctcagctgcctccccacggggcagggctcgggacttgcatcccgccatgcccaagccccacccgacctgtctgggtgggctcccgctctgcccgaacctccccgacaggcctgccccctgctccacagtgcctggtcccatcaactgcccaagggctgaggagtgcaagtgtgcagcttacagcttactaagcttctctaaaccaatcattttgaattctttgtcaggaaattcaaggatttccatttctttggggttggttactggaaaatcagtcatgtttcattggttttatatgtttcttgtagctttgcatttatatctacacacgaaggagcagtcacctcttccacacttttatgggctgcctttggtggggaaagaccttcacctattggtgggtgtgaaggcaccagctggggtgtgacagctctggctccaggtggatacatcttggactctgggcagcttaatcagctggggtcagcatcagtgaagactgtgggcaccatcagtcataaaaactgtgggtgtccatgatggtgacaaaagctgctggggtcctcagtggcaaaggctactggacttctgctctcctttttccccacagagagaggtcacagccaaaacgatcccctttgttgccaagctgtgccagggtagaagatgaggtgatgcagataaaacgcttccaacacttttatatacagctgtccttggtttgggggtgctttaatgggttcctgcagcttcttcactgtactctggagtattctcagagctatttttgttggcaagtagctgttaaattcttgcttttgttggggagacaagagctgggatctcctagtgtatcatcttgttgatattacttgcctgcttttaatattttaactaatttttctgattacaaaggaattgaggttctctgaagaatatttcagatatttaggaaattttaaaataagatgaaaatattgattaatattctggtataaatccttccagacttttacaatgcatttgtaagtacatctacatttttgcaaagagaatactgtatttttcagatgatcatattgaaaatgcacttttgtcttggtgtactactattttgtgaacattttttgaggtcattatttgtctgtagcttgacttgtaatggctgcctggtattccatcatgactgactttattaaaccactttcatgccattgacatgtc

SEQ ID NO: 3101 - DNA, 1868 bp, Homo sapiens
ctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaagcccccctctgtcctggcacccagtgttcctccatcctgactccacgtattgcccccttgccactgcctgagtgcaccatagtgtccccatccccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaag

SEQ ID NO: 3102 - DNA, 639 bp, Homo sapiens
tgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaaggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaata

SEQ ID NO: 3103 - DNA, 648 bp, Homo sapiens
agtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacaca

SEQ ID NO: 3104 - DNA, 740 bp, Homo sapiens
gccaggcagtcgcctagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatgatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaa

SEQ ID NO: 3105 - DNA, 663 bp, Homo sapiens
tggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcctaaggattttcagcaagtgtttactctgccatattgaccagaagtctaaaaacccctcctctggcctcttagcagctgactccatcattcaggcacacccctcacctgtgcagattctcaggcaaatgtacattaataatgagctagaagggagaggttttatttgggattcatcaatttcctggaggttcatgtggaacatctatggcacaggggagtactga

SEQ ID NO: 3106 - DNA, 3095 bp, Homo sapiens
gttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaagattagctgggcgtggtggcaggtgcctgtagtcccagctgctcgggaggctgaggcaggagaatagcatgaacctgggaggcagagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaaa

SEQ ID NO: 3107 - DNA, 2716 bp, Homo sapiens
ggacttcagcttggcctgggcctctcgcttcctctcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaa

SEQ ID NO: 3108 - DNA, 1856 bp, Homo sapiens
tcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaatgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagcttttcaagctgacctcagaatttcctctctgagggacttcta

SEQ ID NO: 3109 - DNA, 3466 bp, Homo sapiens
agagagcgcgggggcctccagccgagaggaagggagggcagctcgggccgaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgaaggtgacaaagtacaatttgaagaatttgcaaaagtagtaaggaatatgcgtgatgctgccaggttagaagagttacaggaagttgtcttagctgctgatttgctggaaggtgacatgatagctgggaagaacttggaagactttctaagaaatgttgggattaagtcacctaaagaagaggtagagaaaattcttcaatcagattttgtttctgaagataacatggtgaacattaaagactgtatgagggctttgagggacacccagaaattttccaattatattgatttcaggaaagaggcttcaaatctaaaattaccaaaggtaaacgagattaaagaagctgctaacatcttgtcacatgtcgataatggcaagattggtatacctgatttggagcatgccttgaaatgtttgaatgttaatttaactgaggaggacttcaatgaagcccttaactgttgtaacgtcagtgataatatggaggtggatttaaaagatttcttaatgaaaatgaaagaaagtccacatttccaaaagtccaaggctacacagatactcttagctactacccaaattctccagaatgatctagttgatgtctctgacctcaagacattattgatggacaaggaccttcatacagctaatgctatacttactgtaatgttaagacatgtacctgaacatggttagtagtttcaatgcgtctatcttataaggaccatcctctaccacaggggtggaaggtctatgggtaggacatgcagggatggagggtatcctgtggaagctgaggtgggatgactgctggacactggtactgcccctacaggtgtgccaaccctgagcttcatggggccaaacaaatggggaagtcagagctcatcttatccctgtgtgagtccactgacagtacctaggaggtgagattattttgtgaactgactgacatgcacagtggtcaatcagaatgccatccatagagtaaaacagggtcctggaggcccttttggtttttggaaggtaaattatgatgatatccagggataccagggggtgttgcacatagtggtggctcagggcagcagatatttataaatataaaaaataattttactattttaatgacaggtatagctgaatattatccatgatgggttcttaaaatgagttggggagtatttttttgttttgttttttaaaagagacttttttcttccttgaatgttgagtagaattcataggtgaagccatgtgggccaagagtttttttgtgaaaggctttggattatttatttaatgtctttaaatgaataggattaacaaggtattctattttcttgttagttttggcaagctatgtttttagaggaattcgttcattagatctgccttttcaaatgtattgaataaagttgttctctttttgacatctga

SEQ ID NO: 3110 - DNA, 6167 bp, Homo sapiens
gcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagggctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttctctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcagtaaaaagaaa

SEQ ID NO: 3111 - DNA, 1231 bp, Homo sapiens
gggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggccgggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatt

SEQ ID NO: 3112 - DNA, 527 bp, Homo sapiens
aggccaggctcgccgcggggcgctgagcaggccgggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacc

SEQ ID NO: 3113 - DNA, 1542 bp, Homo sapiens
tttattggattcctgatctgattgaagcccagaagtggtaggtagcacggcttaaaagtagacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccaggaatgttgtggagtccctacactatgggctatggaaaaaggacacttaagccagacatatgcacacctccaagctcaagcatggctgcctttgctaatgctgcccggattgcaataatgaaagaaaaggatttatttaaatttcttgaagagctcaagagatgcaattccggttcagatagcccatattcaaaaatacccatctttccattgttccctaatgtggatggggtggtgatgggaaagccattcaaagacatgcagaaattagagatgctaagaataaaggagcctttgcatttctttgaggattattttttccataaaagagactggaaaacacaggcagcaaatataaagtctatggaccctgcctcaggttattcaaataacatcttcaccattgatcaaatgctcaagaaaaagcagacttgtacagtggccgatgcaactgctattaaacaacatgtgaagagagctactgatacctataatttaggaattgcccttgaacaccgaaaagagatgctaaacctctggcagaagatccgaggggatttgattgggatggactctagaaatgagtccttttatgacaccttttctacttatacatggtcctggaatgtttgccaagaattactttctcctaaggacttaaggttatatgatgcctatgtgaatagaaattcctcccataactccagatcctcttcctcatcagataccagtgaatgttacacagactcaggaagaaaaagaaaacggaaaggtttaaagggatttcaacaatgaaatttctacattttctaaacagctcatcacaaactactttttcatagttatcaaaattattgtttcttgcttttgtctaagtacattcttagaagctggaaattttgacatcttttggattctgaccagtaaaaaagtttaagtcat

SEQ ID NO: 3114 - DNA, 710 bp, Homo sapiens
agaagtggtaggtagcacggcttaaaagtaggtaaatatcgtgattttgtaggattctatgctaagtcctttttaaaaaatctattatctatgagaattgaaggtatttttttaaagaaatgattattttgaggtatggggatgatttcacagcacctttcaaatgcctgaattgttgagccattctggtgttcccagctctgtggcagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaag

SEQ ID NO: 3115 - DNA, 574 bp, Homo sapiens
attggattcctgatctgattgaagcccagaagtgacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccag

SEQ ID NO: 3116 - DNA, 1691 bp, Homo sapiens
ggagaggtgattgatgtccagaacttagacaatttctagcaagcgaagggattgagctcacagaagaagaaatgaaggagttgatgcctcatttgacatttaacggaaatggaaagattaatgttaattcaataatggagggcctgaagaagtttaaaccaaaaggaatggtgactctgcataagttgaaaactgcaaatgatattaaagacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccaggaatgttgtggagtccctacactatgggctatggaaaaaggacacttaagccagacatatgcacacctccaagctcaagcatggctgcctttgctaatgctgcccggattgcaataatgaaagaaaaggatttatttaaatttcttgaagagctcaagagatgcaattccggttcagatagcccatattcaaaaatacccatctttccattgttccctaatgtggatggggtggtgatgggaaagccattcaaagacatgcagaaattagagatgctaagaataaaggagcctttgcatttctttgaggattattttttccataaaagagactggaaaacacaggcagcaaatataaagtctatggaccctgcctcaggttattcaaataacatcttcaccattgatcaaatgctcaagaaaaagcagacttgtacagtggccgatgcaactgctattaaacaacatgtgaagagagctactgatacctataatttaggaattgcccttgaacaccgaaaagagatgctaaacctctggcagaagatccgaggggatttgattgggatggactctagaaatgagtccttttatgacaccttttctacttatacatggtcctggaatgtttgccaagaattactttctcctaaggacttaaggttatatgatgcctatgtgaatagaaattcctcccataactccagatcctcttcctcatcagataccagtgaatgttacacagactcaggaagaaaaagaaaacggaaaggtttaaagggatttcaacaatgaaatttctacattttctaaacagctcatcacaaactactttttcatagttatcaaaattattgtttcttgcttttgtctaagtacattcttagaagctggaaattttgacatcttttggattctgaccagtaaaaaagtttaagtcat

SEQ ID NO: 3117 - DNA, 4759 bp, Homo sapiens
agttggaaaagttcagcagttgagaatttatcattcaatagaattgtggggtgaggtgagggcaggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagctaaactacacatccaatttccaaagccacaccctggtcacgaagtgagattgtcttcaaaacaatttcagaattacatagaattggttgtgtctgaactcaggggcaatgaagaccaagttctggaaagtgttgtggaatttctgatgaatgctttagagaggagccacattgagagtctgaggaattctgccaggcggaaatggctgcaccaaatccaatgtgctgcagagacaagtggggtgtccctagagccggtgtatagtgagacctttaaggccctcatgcaggatgctgaagcccatggaaataaaaagatcagtgctcacatttccctcttagaagaaaacctactactgcctgagaaagggaatgttctattgaggaatgtggcttgtaccttagatgatgctcaatttgtactgaacagagtgctctacagggacatgaaaggaatcagctttacagtagtggatgaagggaagccaatccatgttccccaagttcagtaccatgggaacatcttcttctggaaccagtcccgtaataagcatgattataatggttcattcctggctctgcctcttcaagatgcatatatgaggatctttggggtcttggctgttgatacccttagagatccccacgaaataaacatctttctacctcatgagatcagattctatcagggtgttgctaatgtctttagcactgcctatcactacgtccacagccgggagcacattctgcatattgtgatcactggcataggctggctttatgacgtcacatccagcatcacctccatcactacgtactttgtagagcctagcccagcccaggattcagactatgttttacgcaacatgatggttacagggcagctgggtctaacagaaatccacaaaaatcctcctaccatccacaggaagtcatgcatcttcagagatttcctctttaaatgtactgacagttcagaagttgttctggcttctgcctgtggagaaacgcatatagtagttccacttcgtgagagaacaggagaggctctgggagtcctcgattttaacatcggccaaaataggatgttgttgtgtcaagaatataaagatctacagaaaatgatgaaagtggtccaagtggcctgctatgaaatacttggcgagttctctggagagataaagaaaaaatatatcttagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgg

SEQ ID NO: 3118 - DNA, 2973 bp, Homo sapiens
agttggaaaagttcagcagttgagaatttatcattcaatagaattgtggggtgaggtgagggcaggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaaggtctcactctgtcgccaggctggagtgcagtggcgcaactgtag

SEQ ID NO: 3119 - DNA, 3547 bp, Homo sapiens
agttggaaaagttcagcagttgagaatttatcattcaatagaattgtggggtgaggtgagggcaggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgg

SEQ ID NO: 3120 - DNA, 5132 bp, Homo sapiens
agttggaaaagttcagcagttgagaatttatcattcaatagaattgtggggtgaggtgagggcaggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaagctaaactacacatccaatttccaaagccacaccctggtcacgaagtgagattgtcttcaaaacaatttcagaattacatagaattggttgtgtctgaactcaggggcaatgaagaccaagttctggaaagtgttgtggaatttctgatgaatgctttagagaggagccacattgagagtctgaggaattctgccaggcggaaatggctgcaccaaatccaatgtgctgcagagacaagtggggtgtccctagagccggtgtatagtgagacctttaaggccctcatgcaggatgctgaagcccatggaaataaaaagatcagtgctcacatttccctcttagaagaaaacctactactgcctgagaaagggaatgttctattgaggaatgtggcttgtaccttagatgatgctcaatttgtactgaacagagtgctctacagggacatgaaaggaatcagctttacagtagtggatgaagggaagccaatccatgttccccaagttcagtaccatgggaacatcttcttctggaaccagtcccgtaataagcatgattataatggttcattcctggctctgcctcttcaagatgcatatatgaggatctttggggtcttggctgttgatacccttagagatccccacgaaataaacatctttctacctcatgagatcagattctatcagggtgttgctaatgtctttagcactgcctatcactacgtccacagccgggagcacattctgcatattgtgatcactggcataggctggctttatgacgtcacatccagcatcacctccatcactacgtactttgtagagcctagcccagcccaggattcagactatgttttacgcaacatgatggttacagggcagctgggtctaacagaaatccacaaaaatcctcctaccatccacaggaagtcatgcatcttcagagatttcctctttaaatgtactgacagttcagaagttgttctggcttctgcctgtggagaaacgcatatagtagttccacttcgtgagagaacaggagaggctctgggagtcctcgattttaacatcggccaaaataggatgttgttgtgtcaagaatataaagatctacagaaaatgatgaaagtggtccaagtggcctgctatgaaatacttggcgagttctctggagagataaagaaaaaatatatcttagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgga

SEQ ID NO: 3121 - DNA, 3504 bp, Homo sapiens
ttagggcagatgaaatgtaaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcatcccatactcctatcaagatacagaacaaagagcactgtgacactcacctgtaatcccagctactcaagaggcagaggcaggaagattgcttgagcccaggagttcaagatcagcctgggtaacattgcaaaaaccatctcttaaaaaaaataaataaaagatatagaacaaaaaaagtccccacacctctttcccattcagtcgtccaccctccaatccccaaagcaaccacttttctattttctaccataaattagttttatctcttctggaatttcataaaaatgaaattatacagtatgcatctttttttacagagtttaaactctatgtactctttttgtaaggcttctttcactcagcataatttttacttttttaaaaattttttgggggagacagagtctcactctgttgcccaagctggagtgtagtggcatgtgatcataactcactgcagccttgaactcttgggctcaagcaatcctcccgcctcagcatcccgagtagctgggagactacaggtgcacaccaccatgcctggctagtttataaactttttgtagagacaaggtctcaccatgttgcccaggctggccactaactcctggcctcaagtgatcctccctccttagcctcccaaagctctgaattatattcataagccactgggcctggttgactcagcataatttttcttgagagtcttaatatgttgctacatgtatcagcaatttgcttctttttattgctgagtagtattccattgtatgaatacaccatggtttgtttatccgttttcctatgtatggacacctgggctgtttccagttcttagctattataaataaagctactctgcacaatctt

SEQ ID NO: 3122 - DNA, 1853 bp, Homo sapiens
agtggcgttcggcgggacccgctgaggcaaagcggagccgcagtgacagaagcaagcggagcggccgccaggaaggactcaccgaggcgcaggggctggaggtggtgctgggggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgttgcagattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaact

SEQ ID NO: 3123 - DNA, 3743 bp, Homo sapiens
agtggcgttcggcgggacccgctgaggcaaagcggagccgcagtgacagaagcaagcggagcggccgccaggaaggactcaccgaggcgcaggggctggaggtggtgctgggggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcatcccatactcctatcaagatacagaacaaagagcactgtgacactcacctgtaatcccagctactcaagaggcagaggcaggaagattgcttgagcccaggagttcaagatcagcctgggtaacattgcaaaaaccatctcttaaaaaaaataaataaaagatatagaacaaaaaaagtccccacacctctttcccattcagtcgtccaccctccaatccccaaagcaaccacttttctattttctaccataaattagttttatctcttctggaatttcataaaaatgaaattatacagtatgcatctttttttacagagtttaaactctatgtactctttttgtaaggcttctttcactcagcataatttttacttttttaaaaattttttgggggagacagagtctcactctgttgcccaagctggagtgtagtggcatgtgatcataactcactgcagccttgaactcttgggctcaagcaatcctcccgcctcagcatcccgagtagctgggagactacaggtgcacaccaccatgcctggctagtttataaactttttgtagagacaaggtctcaccatgttgcccaggctggccactaactcctggcctcaagtgatcctccctccttagcctcccaaagctctgaattatattcataagccactgggcctggttgactcagcataatttttcttgagagtcttaatatgttgctacatgtatcagcaatttgcttctttttattgctgagtagtattccattgtatgaatacaccatggtttgtttatccgttttcctatgtatggacacctgggctgtttccagttcttagctattataaataaagctactctgcacaatctt

SEQ ID NO: 3124 - DNA, 2454 bp, Homo sapiens
agtggcgttcggcgggacccgctgaggcaaagcggagccgcagtgacagaagcaagcggagcggccgccaggaaggactcaccgaggcgcaggggctggaggtggtgctgggggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcagattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcatcccatactcctatcaagatacagaacaaagagcactgtgacactcacctgtaatcccagctactcaagaggcagaggcaggaagattgcttgagcccaggagttcaagatcagcctgggtaacattgcaaaaaccatctcttaaaaaaaataaataaaagatatagaacaaaaaaagtccccacacctctttcccattcagtcgtccaccctccaatccccaaagcaaccacttttctattttcta

SEQ ID NO: 3125 - DNA, 2313 bp, Homo sapiens
actctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctttca

SEQ ID NO: 3126 - DNA, 702 bp, Homo sapiens
gatgagactgaagcaaggatcgtttctgtggtacctctatctggacaaaatatactgcttattatccgtgagaaacgtgaaggctttggcagaatattttcatattctggacgtgcacggcaagaacaccttgaatgatgtgctgttctatcacttccttcatcatgtgactgacttgaaaaaggcacagatcaacattgtgtttgacatgctggactggaacgctgtgggcgagatcgactttgagaagttctacatgctggtgtgcatgctgctggcccaccagaaccatttggaaggacagtttatgtatcgtcattcccggcctgtctttgacctgcttgacctgaaaggggatctgagaattggtgcaaaaaacttcgaaatgtacagatttctcttcaatattcaaaaacaggaactcaaagatctcttccgtgactttgacattacaggtgacaatcgtcttaattatcaggaatttaagctgtatacaatcatctacactgacaaattacagaagaggcagaaaacagaggagaaagaaaaaggagagagaaagagaagtctctactcaaaatgtcacatcaagtagatacaagctgaaagagtcttggaaaaaaatgggatctgaaagtacagaacatgaacattgatgaagactgttaacatgtctaaaaataaattcagagcatcaaagta

SEQ ID NO: 3127 - DNA, 3671 bp, Homo sapiens
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacct

SEQ ID NO: 3128 - DNA, 3635 bp, Homo sapiens
gtgcgcgcgcgtctgcgctgcgaggacaaagatgcctcgggccggggaccctggggtcctctccaggcccggcgcgtgccggtgctgggcggtggtccttcggggggcggaggctcaggggaaagcgggtctcccggagccgagcagaccgggagtgctggaggaggtggtcgtgtggcagcatttgcggaattaacaaaagcggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacct

SEQ ID NO: 3129 - DNA, 5185 bp, Homo sapiens
cgggggtgcggctccaggaaacggcgcgctcccagctccgcgctcgccacccgacgcgccccaggcgaccccgcagactcagccagaccaccctgcgggccccagcggcggcagcggagagcgcggtcccgggtcggagcctgggacacctccgcacggacggggcgggcggcgcggacaggccatggggacccgggccgggccagcggtggcgggccagcgggagccccgggcctgagaagtgggcggcggggtggcgggggccatgacctcggtgtggaagcgcctgcagcgcgtgggcaagcgggcggccaagttccagttcgtggcctgttaccacgagctagtgttggagtgcaccaagaaatggcagccagataagctggtggtggtatggacccgtcggaaccgacgcatctgctccaaggcccacagctggcagccgggcatccagaacccataccggggcaccgtggtgtggatggtacctgagaatgtggacatctctgtgaccctctacagggacccccacgtggaccagtatgaggccaaagagtggacatttattattgaaaatgagtctaaggggcagcggaaggtgctggccacggccgaggtggacctggcccgccatgcagggcccgtgcctgtccaagtcccagtgaggctgcggctgaagccaaagtcagtgaaggtggtgcaggctgagctgagcctcactctttccggggtgctgctgcgggagggccgtgccacggacgatgacatgcagagtctcgcaagcctcatgagtgtgaagcctagtgatgtgggcaacttggatgactttgctgagagtgatgaagatgaggctcatggcccaggagccccggaggcccgggctcgagtcccccagccagatccctctcgagagctgaagacgctttgtgaggaggaggaggaaggccaaggacgaccccagcaggcagttgccagcccttctaatgctgaggataccagcccagcccctgtgagtgctcctgcacccccagccagaacctcccgaggccaggggtcagaacgagctaatgaagcggggggccaggtaggccctgaggccccaaggcccccggaaacctcaccagagatgaggtcttcaaggcagccagcccaggacacggcccccaccccagcccctcggctccggaaaggctctgatgccctccggcccccagtcccccagggggaagatgaggtccccaaagcctcaggggctcctccagcaggattgggctctgctagggagacccaggcccaggcatgccctcaggaagggacagaagcccatggagctaggctgggcccgagcattgaggataaaggttctggagacccttttggaaggcagagactcaaggctgaagagatggacactgaggacaggccagaggccagtggggtggacactgagccaaggtcaggaggcagagaggcaaacactaagaggtcaggagtcagagctggggaggctgaagagagttcagcagtttgtcaagtggatgctgagcagaggtcaaaggtgagacatgtggacactaagggaccagaggcgacaggggtgatgcctgaggcaagatgcagggggacccctgaggctcctccaaggggctctcaggggaggctgggagtcaggaccagggatgaggctccctcaggcctgagcctgcccccagcggagcctgcagggcactctgggcaacttggtgacctcgagggggccagggctgctgcaggccaggagagagagggtgcagaagtgaggggtggagcacctggtattgaggggacaggcctggagcagggcccttctgttggagcaataagcaccaggccccaggtgagcagctggcagggggccctgttatcaactgcccagggggcaatatccaggggtctgggaggctgggaggcagaagctgggggttcaggggacctggaaacagagactgaggtggtagggttggaggtgctgggaacccaggagaaagaagttgaggggtcagggttcccagagactaggacactagaaattgagatattgggggccttggagaaagaagcagcaagatcaagggtcctggagtcagaggttgctgggacagcacagtgtgagggactggagacccaggaaacagaggtgggggtcatagagaccccagggacagagactgaggtattggggacccagaaaacagaagctgggggttcaggagttttgcagacaagaactacgatagcagagactgaggtactggtgacccaggagatatctggggatttagggccactgaagatagaagatacaatacagtctgagatgctggggacccaggagacagaggtggaagcttctagggtaccagagtcagaggctgaggggacagaagctaaaatattagggacccaggagataacagctagggattcaggggtcagagagatagaagcagagatagcagagtctgacatattggtagcccaggagatagaggtgggacttttgggggttctgggaatagagactggggcagcagaaggtgcgatattggggacccaagagatagcatctagggattcaggggtcccagggttagaagctgatacaacagggatccaggtgaaagaggttgggggttcagaggttccagagatagcgactgggacagcagaaactgagatattggggacccaagagatagcatctaggagttcaggggtcccagggctagaatctgaggtagctggggcccaggagacagaggtcgggggttcagggatctcagggcccgaggctggaatggcagaggcccgagtactgatgacccgtaagacagaaattatagttccagaggctgagaaggaagaggctcagacttcgggggtccaggaagcagagactagagttgggagtgctctcaaatatgaggctttaagggccccagtcactcagccaagagttttaggatcccaggaagcaaaagcagagatttcaggagtacaagggtcagagactcaagttctgagagtccaggaggcagaggctggggtttgggggatgtcagagggcaaatctggggcttggggggcccaggaagcagagatgaaggttttagagtctccagagaacaaatctggtacttttaaggcccaggaagcggaggctggggtcttgggaaatgagaaggggaaagaagctgagggaagcctcacagaggccagcctgcctgaagcacaggtggccagtggggcaggggctggggcgcccagggcctcttccccagagaaggctgaagaggacaggaggctgccgggcagccaggcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagattgactatgcctcgctagacccactcaacatcaagcagaacaacaagcaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggccgcgcctccaaggacggcggggccgaggccccccgagagtcgcgacccgcggaggtcccggccgaggggctggtgaacggggcgggggcaccgggcggcggcggcgtgaggctgcgacggccctcggtcaacggggagcccgggtcggtgcccccgccccgcgcgcacggctccttctcccacgtgcgcgacgcggacctgctcaagaagaggcgctcgcggctgcggaacagcagctcgttctcgatggacgatccggacgcgggagccatgggagctgcggctgcagaaggccaggcccctgaccccagccctgccccaggcccacccacagctgcagactctcaacagccccctggtgggagttccccctcggaggaaccacccccaagcccaggggaggaggctgggctgcaacggttccaggacacaagtcagtacgtgtgtgcagagctgcaggccctggaacaggagcagaggcagatagatgggcgggcggctgaggtggagatgcagctgaggagcctcatggagtcaggtgccaacaagctgcaggaggaggtgctgatccaggagtggttcaccctggtcaacaagaagaacgctctcatccggaggcaggaccagctgcagctgctcatggaggagcaggacttggagcgaaggttcgagctgctgagccgcgagctgcgggccatgctggccatcgaagactggcagaaaacgtccgctcagcagcaccgagagcagctcctactggaggagctggtgtcgctggtgaaccagcgcgatgagctagtccgggacctggaccacaaggagcggatcgccctggaggaggacgagcgcctggagcgcggcctggaacagcggcgccgcaagctgagccggcagttgagccggcgggagcgctgcgtgctgagctgaggccgccggcccgggtggcccataacttctcgcgtccccggcgtccgccgccgccccgggcctgcgctgcggacgacccggccgtcccggaggccgcgcgcgtgtccgctaggggccgccggcgcccttccccgtacagggcagggcggatccccgaccccacgggcggggcggccgccgtatttatttgtcaccgagggtgtgtgcgcgctcgcggcgggtgcggggtcctccccgacggcacggccgggccggcggcctcggggagagggatgcctgggcactaccgccccgcgctggcttgccctcctgttctccagagcaataaagttggacgagactacccca

SEQ ID NO: 3130 - DNA, 2852 bp, Homo sapiens
cccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctcaaaaataaataaataaataaataaataaataaataaataaataaataaataaataaaatagtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgta

SEQ ID NO: 3131 - DNA, 1990 bp, Homo sapiens
agtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctc

SEQ ID NO: 3132 - DNA, 2685 bp, Homo sapiens
ccccaagtttggaaagctcttttaacgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3133 - DNA, 2332 bp, Homo sapiens
gcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3134 - DNA, 2413 bp, Homo sapiens
aaatgtagttctcggggccaggggagccggcacggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3135 - DNA, 994 bp, Homo sapiens
aaatgtagttctcggggccaggggagccggcacggaagcggctgtgcgcatgagcagatgaggcctagccgaggcggcgggacccccaagtttggaaagctcttttaacgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcaggg

SEQ ID NO: 3136 - DNA, 2564 bp, Homo sapiens
ggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgccgagcgtgttggctcatgcctgtaatcccagcactttggaaggccgaggcaggcggatcacgagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 3137 - DNA, 2601 bp, Homo sapiens
aaatgtagttctcggggccaggggagccggcacggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaatt

SEQ ID NO: 3138 - DNA, 1209 bp, Homo sapiens
aataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaag

SEQ ID NO: 3139 - DNA, 1165 bp, Homo sapiens
gcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagattgaaagaaatcaagggaagggatga

SEQ ID NO: 3140 - DNA, 3675 bp, Homo sapiens
agagacgtgcgggtgaaaggtcgagcgacagccggccccgccccctggcgcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagag

SEQ ID NO: 3141 - DNA, 3470 bp, Homo sapiens
gcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaa

SEQ ID NO: 3142 - DNA, 521 bp, Homo sapiens
gggtgcgacccgagagaaggagcggggctggtggggctgctgcagccgaaaggaatgaaagaccggcagtgcacctgcttggataataagcacgtgacccaaaactttgttcgggctccatgggcaggaataaagctgggtatttgacctcgcgcgaggacgagcgagaatgtcagaatgagggacttgggggaagactgaagagagaaagggagcatcttcttcagcattttctctccctcctggatgcaacccttcctgtacgtggtcattggcctggagatgtttactggagtactcctccaccggcagggttactggtgtcactgtgcacccagtcccctcgagctgcgtgattcatcgcagcctttggatccggaaggatgagcaaactccttaagtgtaatcgtgtcacaggaaataagtaatcatggtgctcaacagtttggataagatgattcaactccagaaaaacactgccaacatcaggaatatttgtgttttggctcatgttgaccatg

SEQ ID NO: 3143 - DNA, 542 bp, Homo sapiens
gtctggggccggggcggtcgcctgtctgtgtggacccaggatcctcaaagagaacgaatctgggaccctgcagaaatgaagggcatgtagtgtagaggtttttcctttttatttagaaaggaatgaaagaccggcagtgcacctgcttggataataagcacgtgacccaaaactttgttcgggctccatgggcaggaataaagctgggtatttgacctcgcgcgaggacgagcgagaatgtcagaatgagggacttgggggaagactgaagagagaaagggagcatcttcttcagcattttctctccctcctggatgcaacccttcctgtacgtggtcattggcctggagatgtttactggagtactcctccaccggcagggttactggtgtcactgtgcacccagtcccctcgagctgcgtgattcatcgcagcctttggatccggaaggatgagcaaactccttaagtgtaatcgtggaaataagtaatcatggtgctcaacagtttggataagatgattcaactccagaaaaacactgc

SEQ ID NO: 3144 - DNA, 607 bp, Homo sapiens
ttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggtgacctcgtgtcggcaccacgcccttctcccatgggcagtcctgggcgccccttcctggccttgggcccagtggcctgtggcctgaccccgtccactcctgcttggttgt

SEQ ID NO: 3145 - DNA, 579 bp, Homo sapiens
ggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaa

SEQ ID NO: 3146 - DNA, 438 bp, Homo sapiens
tgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatctgatgcaagatgggtttattttgatccaaccattgtgtctgtggaaattctgaccgtcgccctggatgggtctctggcattgttcctcatttatgccatagtcaaagaaaaatattaccgggacagagtggcctggggtgaatag

SEQ ID NO: 3147 - DNA, 2719 bp, Homo sapiens
ttcactgctctgtgtcttctgctcctagaggcccagcttctgtggcctcgttacctgcaggtattgggagatccacagctaagacgccaggacccactggaagcctagaaatgttgcaggaattgtgccttggatccatccatccagtcagctgaaaccagcagcccaggacaagtggaccagccaacaggacctagaccatgcaacccagctgatcctacgatggaaccaaggtgccagtgagatgacaacagccctgctctggtcactccggaagctgaccagtccacacacggctgaagcttgaggagacaacagccctgctctagtcaccccagaagctgactagtctatgcacggccgaagcttgagtcatcatcagggaagtaaatgtggttagaaatctgaagtccagtaattttccttgtcatattaattactttgctattaagctgtcactttgcttagccttctccccccaggaaaaagccttttctgtccatgctgggtatgaacatgctactcatcactttgttcttgctactccccttatccatgttaaaaggagaaccctgggagggatgcctccactgcacccacactacgtggtcggggaacatcatgactaaaaccctgttgtatcacacttattatgagtgtgctgggacctgcctaggaacttgtactcacaaccagacaacctactcagtctgtgacccaggaaggggccagccttatgtgtgttatgaccctaagtcttcacctgggacctggtttgaaattcatgtcgggtcaaaggaaggggatcttctaaaccaaaccaaggtatttccctctggcaaggatgtcgtatccttatactttgatgtttgccagatagtatccatgggctcactctttcccgtaatcttcagttccatggagtactatagtagctgccataaaaataggtatgcacaccctgcttgttccaccgattccccagtaacaacttgctgggactgcacaacgtggtccactaaccaacaatcactagggccaattatgcttaccaaaataccattagaaccagattgtaaaacaagcacttgcaattctgtaaatcttaccatcttagagccagatcagcccatatggacaacaggtttaaaagcaccgctaggggcacgagtcagcggtgaagaaattggcccaggagcctatgtctatctatatatcataaagaaaactcggacccgctcaacccaacagttccgagtttttgagtcattctatgagcatgttaaccagaaattgcctgagccccctcccttggccagtaatttattcgcccaactggctgaaaacatagccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacacccaagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacaatgaatggcctcctgaaagaataattcaatattatggcccagccacctgggcagaagatggaatgtggggataccgcaccccagtttacatgcttaaccgcattataagattgcaggcagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcaaccttactaactgctgcctggaacttgatgacgaaggaaaggtcatcaaagaaataactgctaaaatccaaaagttagctcacatcccagttcagacttggaaaggatagtctccagattcccttttcagaggttggttctcatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaa

SEQ ID NO: 3148 - DNA, 2744 bp, Homo sapiens
tcttggtcttctggcctggcggcgatcgtcggccagtttatccctcggagttgcactggcagacacgccgctactttgtagcgggtttcgggcgggccacgcgtgcggcgacaggaacccaaccccggccgaccttgggctccaggaattcgttgtctacgtctgcggaggtgcggcagcctcagttttaagcgcaggaaggcaatagaggctgtgctctgaacctttccctcacgatgatcttctgcctgttgaccatcctggtgtctttcccatgtggccctgtatggttggcatggttcctgtctttaggacttgtgatcaagtatatctgaaagtttttagaagaaaagatgtgttgtaacctccctggaaaaagaagagaccttatgaagtactgctaaccacctacatagtcatcaaaataaaattcctgaatttgtacaagccacaggaagctagattgagatcattatatgacaactggaaggccaaggctatgggttacctcaaattgaggaattttggcacctactcacaggctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatacaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgatctgttaa

SEQ ID NO: 3149 - DNA, 3830 bp, Homo sapiens
agagtcttccctgcgccgaaagcgcaggtatgttcctagtcttgagcgggagaaaatcacccagctcggagcacctggccagtgggaccggtgggttcctggtgcctgaatccggctgtccgctctgcggtgccccgccccgccccaacccaggatcttcccagccccgctccgccccaacccaggatcttcccagccctcgtgtgtccccgctcacttcagttcccgccgcgagccttcttcttggtcttctggcctggcggcgatcgtcggccagtttatccctcggagttgcactggcagacacgccgctactttgtagcgggtttcgggcgggccacgcgtgcggcgacaggaacccaaccccggccgaccttgggctccaggaattcgttgtctacgtctgcggaggtgcggcagcctcagttttaagcgcaggtgatcaagtatatctgaaagtttttagaagaaaagatgtgttgtaacctccctggaaaaagaagagaccttatgaagtactgctaaccacctacatagtcatcaaaataaaattcctgaatttgtacaagccacaggaagctagattgagatcattatatgacaactggaaggccaaggctatgggttacctcaaattgaggaattttggcacctactcacaggctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatacaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgatctgttaatttgcaagcccccaaacactggaactaagttgggggcaggatagtttctcccaacagcactttgtaggcttctggatagaccaaagagtgtgtttgaatagataagggaattttgttcccttgattttggttgaaggtagaagaatccaatgtacacatacacaaaactatgtccttaaatttgtctcaaagaataaatattgggtagtcatcagaattgactgaaaacttactttagggagaaagccacaaataatttaggctggtatgatctgagctttcctgatttcccatgggcattttagtggtctaatggaatattagtctgatatgcattttagccatcttatgaaatgggccgcaggtggaagtaggatgcagggagtgttgaggtggcatctattatatcaaatgcttcactctgcccagtcctctggtgagttccttacatgcatctttctagttaatcctctcggtgttcatattttacagattaatcaactcaaagggtagatagcttgctaaagattatactattactgaaaaatagcaagatgcagaacagcatacctagtatgttactcttttttttttttttttgaggcagagtctggccctttcacccaggctggagtgcagtggctcaatctcggctcactgcaacctctgcccccttgggttcatgccattctcctgcctccctcctgagtagctgggactacaggcgcctgccaccacgcctgactaattttttgtgtttttagtagagacggggtttcaccgtgttagccaggatggtctcagtctcctgacctcatgacccgcccacctcaacctcccaaagtcctaggattataggtgtgagccactgcacccagcctcgtatgttactttttattttaaaaaaggggaaatgatatgtatatgtgtatgtatttgcaaataaaacaggaaaagccattcac

SEQ ID NO: 3150 - DNA, 2431 bp, Homo sapiens
acagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccagctatcaacatttctggcatctccagttggatacatcagtctcaagtgaaactgtgggaaggtcccgaagaaccacagaagaacaacagaattcagcacctgagcattcttgtgagccactggagaacttaaaattccacttcaagtgaaaagataagtaaagccttctctctgttcacccaaaactaaagtcaatctcagtacggggaatcttggttgcggtggcattggttcttctccttattttgacccaactggcatgccacctgaagtcccgataacagcctgatttctcactaaacactccatcgaaccacttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatattcgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacctattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatggacaacagattggccttagattacctcttagcagagcagggtggagtctgtgcagtgatcaataaatcctgttgcgtttatgtcaataacagtggggcgatagaggaggatataaaaaagatctatgatgaggctacgtggctccatgactttggaaaaggaggtgcttcagcaagggccatctgggaggctgtgaagtctgccctcccctccctcaactggtttgtccctttactgggaccagcaacagttatactcttacttttcctctttggcccttgtttctttaatttactgattaagtgtgtctcttctaggataaagcaatttcacatgaagtccccccaaatggaaagatatcagctatctgtcattggaggccccagcacctataagcacatctcccccttggatgccagtgggcaaagattccgggaaactatggaggaattttctctctgagacagagcaagagagggagaccctgatgacttcttcgccccatgtcagcaggaagtagttacagaagacccacgacgtccttacaaccagagcttttcagggtctccatctcttgaggagggaaatattagggtaggcaggtaggcaggcatgagcaggcaagagagcccttgggaaaggaatctttagaaacgcagcccactgatagcttccttgg

SEQ ID NO: 3151 - DNA, 1226 bp, Homo sapiens
gggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgagggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctctttttta

SEQ ID NO: 3152 - DNA, 2815 bp, Homo sapiens
gtgcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgtttttttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattctt

SEQ ID NO: 3153 - DNA, 2680 bp, Homo sapiens
gtgcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgtttttttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattctt

SEQ ID NO: 3154 - DNA, 3382 bp, Homo sapiens
agtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccagtgagaaatattttcagtattcgtaacactgtatatgatgaaaggcttctatttggaggaagaaaaattaagaagacaacttacaaaatcaagatgacaacttataaaggcatcattgaggatgattaaggagaatagcctcctttctagcataccaacctcgatactcttattttattccacaactcactatgcatatcttatttaaatgtttttttccttttggtcctttctacttatctattttgtgaattctaaagttacatttgtaagattacataatctattaagcaataagtttatgttagtagagctgttttcaacccaaaaataagaaaaaatagctctaaatatctaaaaggaaaaggttattttatgaaattttaaattagaaaaatttggtaaaatatatgcaactataaaatatcagagaaataacaatttctactgcttacactggtttttatcctctggacaacataaaaaacaaaatatgggagtctttcaggcttttttcacaaacacagaatttggaagccttatagaaaagcttattttggttacttaaagaaaagtagtttatatacaattattttttgaaaattcacttgaaacttgtccatatgagtatctttattcctttattaacttagggcagatataaaataaaggataatatatgacaaattctcacttaccaagaatggttggttgctatttagggtaggctaacagctgtgacagtacactccaaaatgtataattacgtaaacacatattcaattcttgctaacatagcagtactttgctgtgagcaggtcagcaggaacccttttctgcagtcactcagggacccagacttacagagtgggtaggatgcatctgatccagagttagggagaggcacgtacaggccaggcctagaaatgatgcatatcattcccgtttgcatcgctaagtaagcaacttaagttgctttaacaaactaactccaaatctcagtttcctgataaagatacatttttcatttacatcactgtgcaatgtgactaagggtaggggtataagtctgttccatgcagtcactcagggacccagtctccttttgtctggtgactctgttgatccaggcagtctttctctgccaattcaggatgagatgtttaggtaagtattttatttgtgaaatgattgctatacatactcatttttaaataattcaaaatcagtagcaatgcaaaaatattctgattactttagccttatggatattatgctttgaagtcatgagtgggagttgccttaaatgttaaaatgaaaactttgtggttttaacagctaattcttttgctttctgtaaatgtctactaaagaatctagacttttctctatggtctacagtgttgtcctagatgaacattgttgcctttctttcacagagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacatgta

SEQ ID NO: 3155 - DNA, 1318 bp, Homo sapiens
agtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataagtaagaatggatctttaaagtataacaatttcaatgtaggggaaaaaaacatggaaaatataaaaaactccaagtttttcaaaaaggaaaatactatgaagagaataaaaatagtcttaatcagaatgcttaggcaatatgcaaagaataattgagttattcacttacacaagaagaaattttgtttttactagtgtcacgttttccacatataaactattaaatttgagaatatgtgttccagttccacaatgtaattcattattattatgtacttgtttcacataaacattaatttctaggtcctgaaaaataaagtcagcactcagaactt

SEQ ID NO: 3156 - DNA, 1943 bp, Homo sapiens
agtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccaagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacatgta

SEQ ID NO: 3157 - DNA, 2423 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 3158 - DNA, 2779 bp, Homo sapiens
agggacgctcgtgggaccccaggctaaaccccgctgtagccttaaatctcctaccatggaggaagaaggcggcggccgcagctgtgggaccactagggagctgcagaagctgaagcagcaggcgatggagtactaccgggagaacgacgttccgcgcaggctggaagagctgctcaactccaccttctacctccagcctgccgacgtctacgggcacctgaaagcaaactgcttttctaaacttgcaaagcctcccaccatatgcaaaatagtggggaaagacgtactagatggactggggcttccaaccctgcaagtggacatattctgcaccattcaaaactttcccaagaacgtatgttctgtggtgatctcgactcattttgaagtccatgagaatgctctgcccgagctggccaaggcggaggaggcagagagggccagcgcggtgagcaccgccgtgcagtgggtcaacagcaccatcacgcacgagctccaggggatggcaccctctgaccaggcagaggtggatcacctactcaggatattcttcgcaagtaaagtacaagaagataaggggagaaaagaattggaaaagagcctggaatactcaacagtgcctacacctctacctccagtaccaccaccaccaccccctccacctcctaccaaaaaaaaggggcaaaagccagggaggaaggatactattacagagaaacctattgcgcctgcagagcctgttgagcctgtactcagtggcagtatggccataggggccgtgtcactagctgttgccaaagcctgtgccatgctgcttaataaacctctgtacttaaatatcgctctactgaagcacaatcaggaacagccaacaacgctatctatgcctttgctgatggtatcgctggtcagctgtgggaagtcatcatctgggaagctaaatttaatgaaagaagtgatttgtataccccatcctgaattaacaaccaaacaaggtgtcgagatgcttatggaaatgcagaaacatatcaacaaaataattgaaatggtatcaccctctcctccaaaagcagagacaaaaaaagggcacgatggaagcaaaagaggtcaacagcagatcactggcaagatgtctcatcttggctgtttaaccattaactgtgactccatagaacagccactgcttctaatacaggaaatctgtgccaacctggggctagaactgggaacaaatctgcatctagctatcaactgtgctggacatgagctgatggactacaataaaggaaagtatgaagtgatcatgggcacatacaaaaatgcagcggagatggttgacctgtatgtggatctgatcaacaagtacccttcaattattgccttaattgatcctttcaggaaggaggactctgaacagtgggacagcatctatcacgcacttggttccaggtgttacataattgcaggaactgcttccaaaagcatttctaaacttctagagcaaggaaacatcagcatccccaaatccaatgggctgatcataaaacacacaaaccaaactacaatgtctgacttggtggaaataaccaatctgattgacagtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactgggtttcaaagaagaacacacttttttttactttaatgaggaagctgaaaaggctgcggaggcacttgaggctgctgcggctagggagccgctggtgcccaccttccccacacaaggtgtagaggaatcagccgaaacaggagcatcctctggatagggctgtacacaccccaggttccagccacaccatcagtattagtagaccgggaggtctgaagtacggcgccgtgtctccacatggagtttcctcttcaacttcaccaactcttgtggtttttattcttctaattccactgtttggtaaattacatatatgatgtttttgcctgaaattctgtgaacttcgttttgcagccaccacacttccatgtggattttgtttgtctattagctctcctgtccatttttcagggacacgctccagtaaaagaggccaatatttttgttgccaactccacactcagtcaaacaccccatcctttaccaatcagaatatctctgagaacaaaaacctaatgaccctagaagctctctgtgctgggaacagatgtccatcttctgtgtttattctacatgtctgtgctgaaaagcactgacacatttttgtaaccaacctcacgtagaagtgtgagagcatcaccattttttgtaagagccaatttcatctcactttcctacccttgattccttttttcctaattccctctcctttttaaattttagtttttcttgtattatttttatctttgcgagtcttcttagatcctttttggagtaagaatgagtataaatgaataagcacatcagtaaatgaattaatattctcaaggttattaaatgcccagttattcataccacagcatttaaaaagcaatccgcaagtgataaaaaaaaaaaaaaaaaatgatgtgacatatccattgcctgaattgctcttttgtaagccagtgttgggattatagcagaggagtagcagaaataaatatattcagac

SEQ ID NO: 3159 - DNA, 2710 bp, Homo sapiens
ggggaccggcctgggcccttgagcctggctggagtaggtggaatatcctggggagaggaagtttggtcgttgggcagcggccgactttcctctcaggaaattgatactttatcaacatagagattaattatttgtatttgggagcagcagaactggggaccaattacctgtcaagagttttataaacccgtgacataaactgttattccattgctttcatcctccatctcaccttggaacttgtattacttatggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaatcatcacaatatctatttttgatagaactcgtgtggttccacttccccaagacttacgttagcattgtataaattcatattattatggcaaaaaaggggatggtttaatttttccttgtcaggtttattagcaagtatctttcaaactaatactttcatttgggtggtttattttttaaaagggaaagatgtcacctttgataatttcagatttagatattagttcatttgaaacagaagagaatttcattctttcatgctctgtacctcaaatgggttaagcattagtgaaaattgtggtaagacctcaaactgcaaatgactattcaagagcttttggataaggaggcaggaagaagctctttatctttcaactgtatggagcttgttaacaagcctctgaggtgacctaggaggattgagtttgggggtatacatttcacacattcttttgcaagttttaggttctgcaaccaagggccagaaatcttttctttcttccagatgctagtgttaggagttaaatggaaacaagaaggacatggggcaaatgtttttactgtcaatgtatattgcaaggtgaattcaaatgcatccttttattctacttcagaaaataaatttgatatttttca

SEQ ID NO: 3160 - DNA, 1992 bp, Homo sapiens
gccgccccaccttgccagacttagctgaccagccagcaaggacgcccgctgcctcccacctgccctcctgccctccttcaccagccaagcccagcctgagccagcacctgcctttatgaccatgttcaagggactgagcaaaggctcccaggggaaggggtcccccaaggactccccagccaaggggtcccccaaaggctcccccagcaagcacagctgaatgccacccaggagctgaccctgctcatctcccacatgcaagccagcgccgaccaggtggagcgggacatcctggagacgcagaagaggctgcagcaggaccggctgaacagtgagcagagccaggccctgcagcaccagcaggagacgggcagcagcctgaaggaggccgaggtgctgctcaaggacctcttcctggacgtggacaaggcccggcggctcaagcacccgcaggctgaggagactgagaaggacatcgagcagctgcacgagcgggtgacccaggagtgtgcggagtactgtgccctgtacgagaagatggtgctgccgccccgacgtgggatccaaggtcgactgggcacacgtgctggagcagaaacagaagctggtctgcgcaggccagtatgggccgggcatggcggagctggaggaacagatcgcggagctcaacatcgtgcagaaggagatcaacgaccaaggagagcagctgcggagcctggtggggccggatgccgccaccatccggagccaataccgagacctactgagggcggcgtcgtggcgcgggcagagcctgggcagcctgtacacgcactgcagggctgcacgtggcagctgagcgccctggcggagcagcagcgccgcatcctgcagcaggactggagcgacctcatggccgaccctgcgggcgtgcggcgggaatacgagcacttcaagcagcacgagctgctgagccaggagcagagcgtaaaccagctggaggaggacggcaagcgcatggtggagctgcggcaccccgcggtggggcccatccaggcccaccaggaggccctgaagatggagtggcagaacttcctgaacctgtgcatctgccaggagacccagctccagcacgtggaggactacagccggattctgtgtccatcttcctctcctcattgactctgcatgaaggggatttctggtggagtaagggtagcagctcttgccgcacgtgcagagagagaggaacttccagtgcccgctatggagccacagcccacagcatggggaagtccccatccagaggcagtgctgcagctagaggtagctccagagtcctccgggccctgcaccgatacagccaaagaccagcaaagcgacaagctgccagacctcatgccacctgctgtagccactgggctcagccctggagctgagagcatcgctggagatagacgtggcagagaagaggttgcgagcatggccccagccagcagctcccacgctgcccctagtcctgggcatggagcgagccttggtgtcagagaccagggtgtgcagtctgagctcctctaccttactaaagagaggcctcttttatttaccagagccacagccctgctgcctcaggaccttttcattctgccggtgctggggctgtctatctgcaagctggaggtgttgagagcaggaaaaggaggctgtgaggaagggttcgggcagctcctcctgctctcagaggtggcctcctcctccaggcatggaggtctgtccactactgggcttctgggctatttgcccctgatttgctccctggtacgggctcttcttaacaggcaggcaaggggtgcggggaccaggtgagggcttcaaagggtacagtaccaaatcttccaaactcagcacttgtgccctggggtctccaaactgtcttctgccctagaatttattcatactgttaaattaccagtttatgcaaatgatatgtaaataaagctcaattttttgaaa

SEQ ID NO: 3161 - DNA, 2486 bp, Homo sapiens
tttaagctaatttttttcttatttctaaagcaaaacaaaacccaaactcattgtaatcctctttggaattgcattacatgtatatgttcagttgtgaaggcatgacattttatgatagtaaatcttattctggaacatggtatgttgcttcattttattcgtgtttttttgagacggagttttgcttttattgcccaggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccagcccctggcacccaccactgtactgtctgtctctgcggattggaatgcacttctccagcgacctaacaaatacatatggggactccagtacctggagatgtgaattccataaaaatggaagcatctaagaggcagtgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccaggtagcccggcttactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcaggtaggcagccaccttcgcctcaccaaactcgaaacaactcacttgagtgagttgcatcaaacctttctaaatttctcattctagaagttgctgagttgttctgccatgtgttaacttttttttcttatcagtaaaatcttttatttggtttatatttcaaatgtaatttaaaaagtctataagacaggaaattcgataatatgaaagcagggagaaactaagtcgcaccatttagctaagctcagggacaacgttcatttataataaatcaaacatttgatttttttcatgcc

SEQ ID NO: 3162 - DNA, 3487 bp, Homo sapiens
agggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtgagagggggccctgcgggtgggcagaacatgaatgttgacctgcagggcgtgggccctgggctccagggaagcccacaggtcacgctggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccagcaaatacatatggggactccagtacctggagatgtgaattccataaaaatggaagcatctaagaggcagtgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggtgagtgttttctttgtgatatcagaacttcatgttccgggtgaggggcttcagggtgcccgtgtccttgccggggggctccggtctccagtctcctcagcatttccctctggtctccctccagagaggacagatctactcacgatctttgggaccacccagaaagggtcaatttcaaaatcgaattttctcaggatgacttcaaatcaaaacagaaacgtgtggtcttgcctttggtttttccgcccaaactgccttttggctttgccgtgtggggaccgggcacctcgactgtcctctgtgtcctgtgatggggcaggttacgccatgtctgatcagtaggacagcgtcccttgggttcataccctttatctgcagttctaaaactctgaaagctcagacagcagaaaggttttgcccactcagtgttgctcactcattttgcagcaaacctgacccacaccgaggccaggccagccccgcggtcctggtgggtgagtgtgtctgggtgctattgctgtggaaacgtcggcgtgtttggtcatggctgccagatgccgtccctaacactttcccatgcttatttgacttatgtcattaccttacttctctgaaacagtctgaattccaaaccctgtgtggccctaaggattttggataagggactatgtacctataatataaataagccatattatttacaatcatgagtttctgaatgttcactttttttatttttggagacagagtcttgttctgtcacccaggctttagagtaccacagtgtgatctcggctcaccgcagcctccgcctcctgggttcaagcgattctcctgccttagcctcctcggtagctgggactacgggcatgagccaccagatccaactaattttttgtatttttagtagagacggggtttcaccatgttggccaggctggtcttgagctcctgatctcaggtgatctgcccgtctcaccctcccaaagggctgggattacaggtgtgagccactgtgcccagccagaatattcacttctaaatgtgggtgtgtattcaggtgacttgggattaaaaaaaaaagaaaaaacccttatgggattttatatttagaagttctgttgttgaaatatgaacctgtatctgttgttgcagtggcagaaggctgcagcacaatgaatgattattgtgaaagctggtaattttgtgcccacaaataattgtcaagaactttctaataataaaatacagaaatagattaatagttgctacaaacataaagagagactccatggtagaacactttaggaagcacattttatcttttttgaaccaacatgtatttccaaacatgtaagtaataatatcaagcgtggtgggaagattggattggaggctgattctgatctgtgtgttgggatgaactgtggcattcacagcattgagcaaaatcatcttcaaggacagcgtttaattctgttgttgacaagtcttttaagaaaaagtactagtttgggaatttttcacagatacaaataagcttgacccctaaatttaaaatattatttaaaaaataaaatgtcagatttattcatctgtc

SEQ ID NO: 3163 - DNA, 1726 bp, Homo sapiens
gtagtggcctcgccgcccggtccgctgtcgcagcgctcatccgcgccgggagcccttggctgcgtcgcccggcagccgcggctggagtgtagtggcgcaatcttggatcaccacaacctccgtctcccaggttcaagcgattctcccgcctcagcctcctgagtagcaattacaggccgagtctcactctgtcgcccaggatggagtgcagtggcgcaatgtcggcttactgcaacctctgcctcccaggttcaagcgattctcctgcctcagcctccagagtacctgggattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctga

SEQ ID NO: 3164 - DNA, 2172 bp, Homo sapiens
acatccgccggttaccctcgaggctccccggccgcgcgctcccctctctccgtcccatcacccggtgaccccggctgagcgaacgcccacccctccctcagggaccccctccccgtgacacgatcccccgtgaacgcccacctccctcagtgaacactcccccgtgacatgaccccccgcaaacgcccacccatccctcggtgaccctgcgcccgtgagcgcccacccctccccctgcgacccctccccccgccacctggcaactgccgttttcccgccttccctcctccgccccctctcccgcatcaccccgttttctggtgaccgctcccccccatcccgtgacacaaacccccgacctcccagcccttccccggtgacacgatccctgtgaccgtctggcccggtaaccgcccctcccctcatgacccttcacccagtcccctggtgcccacccccgtcactgccgcccgcctggttccagcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctga

SEQ ID NO: 3165 - DNA, 945 bp, Homo sapiens
cctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctggggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagat

SEQ ID NO: 3166 - DNA, 1756 bp, Homo sapiens
gccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctg

SEQ ID NO: 3167 - DNA, 781 bp, Homo sapiens
gtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccg

SEQ ID NO: 3168 - DNA, 583 bp, Homo sapiens
gaagaatctaataataccaccacctttacagtaaagacgctgcgaattgacgccttttataataaagacacttatcttgcccaagagctggggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccac

SEQ ID NO: 3169 - DNA, 3971 bp, Homo sapiens
aagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatggtaaataactcagcatggatgtgtaattttgtataagccgtatatgggaagtgttcacggacttaacctaaaaaaatttatccaggtggggcttccttagtgatgtatgtagagtgtgatggtagatgagaaagaactagttgacctttctttcatgttttgtgatcaagtagcttccaaactgacagaaatgtttcatttttagataattatattcagctctattggttgtattattactttattttttaatactttaactgttggtgcctgatattgttagaattatttgcagaaat

SEQ ID NO: 3170 - DNA, 1144 bp, Homo sapiens
tctgtcccccaggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggctgtatcctaaagcagaatataatggcaaacagtgtagcagatattcaatctaaattgctgctaaaaatggatcaaatgactaccacaagcaaataagaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccaga

SEQ ID NO: 3171 - DNA, 1582 bp, Homo sapiens
acaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaagtga

SEQ ID NO: 3172 - DNA, 1082 bp, Homo sapiens
ggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggagcctccaaaggccgctgcttctagttggccatcttggccccaccccgaaacagtaacctttgaagaataaaagaaaaagcaaaagagtagcattactaaaatattaaacggttacattt

SEQ ID NO: 3173 - DNA, 7997 bp, Homo sapiens
actgcggaccgagcggcgagcgggcaggacagaggtggacctcagcaggctctgcataaccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcgaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactggcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctaagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccaccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgttttttttttgtttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaa

SEQ ID NO: 3174 - DNA, 15267 bp, Homo sapiens
atgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcgaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactggcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctaagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccaccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagaccgaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccagcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaagagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggtgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccaccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggcccaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgatgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtga

SEQ ID NO: 3175 - DNA, 4261 bp, Homo sapiens
gtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagtgcagagaaatgataccagcattccgaactttcctgaagaggcatgataagaccattgttaccaaaatgctgagcctgccagagctgctgctgtacccatcccgaagatttgaagaataccttaatcttctctacgctgtcaggcttcatacccctgcagagcatgttgaccgtggggacttgaccactgcaattgaccaaatcaaaaaatataaaggttatatagatcagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaattttgaactacttcttttggtagctgtatttcatggataatattatttagagtaatttgatgtgatgaaacctaagacagagcaagcacattgtgtaaagctttgttttatgatctaatgaaaaaagcagaatgaaagtgtttcttaagtgatcagtctagaaagatattttaatttgttggtgatttaccatttttaacattttcatgaaacaattattgatttaaaatatggataagagggctgggcatgatgactcacgcctgtaatcccagcactttgggaggctgaggtggcagattacctgaggtcaggagtttgagaccagcctcaccaacatggagaaaccccgtctctactaaaaatacaaaattagccaggcatggtggcacacgcctgtagtccctgctacttgcgacgctgaggcaggagaagaatcacttgtacccgggagtcggaggttgtagtaagctgagatggctccattgcacttcagcctgggtgacaagagcgaacctctgtctcaaaaaaaaaagaaaaaaaaaaggacaagaaatacaaatggcaatttactcaaaaacttgtcacacttatccttagtatgaatgtactcctctagagagcattaaagatataccactacaaagtactaaaaagttttctataatttttaagtgttatttattggaaggctaaattctaagaagctttaacaaatatttttgacattgttaaattagaaggctatttttaaaaagcatattttaaaaaacaaaactaaatggaaacagcaaaacttgcttgtaatgaaatacagctgagtaaaaatgtttctttgaaaacaaagacactcagaaaaacaggtgttgagtagtttcctgggcctttaatgctttaaatttattatttaacaactaaagccatactgaaagccacttggaaacttcagctgatgtatatttttacctagatattgtcaggtaaaaattgtattaatcttggaagcttgaggttgtcagtttcccttgttcttcaaattcttgtttacagtaacaaagtctatcggtgcagtttaggactgtgaatctatagtatttaaacattttttctttcagaaatgaaaatacaaaatcttctatttcttaaaactttaaatcttgttaaaaagatgaacaaaagttaaaatattatgctgttttattggtgtaaaaccacacttctgattctgccaagat

SEQ ID NO: 3176 - DNA, 613 bp, Homo sapiens
ggttggccgtccgggcgcggcggcgggaggggctgcgggcctgtggggcggggtggtggctccgtgttgttggatccctatggagatgaccctgtccctgccccacccctctccggagctgcggcccgagttggcgcagtaaagaaaaagtcaacctccttggctgatgaatcacggcagtttctaagtagcatttcctggaacgttcttaatgcttcccattttcccagcaaagtaaaaaacaacttttgtttaaattcagatttgggtgaaagcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttct

SEQ ID NO: 3177 - DNA, 4319 bp, Homo sapiens
aagggcggtggctcgcacggcgcgggcggctttgctcactgcagctggggagatgcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagtgcagagaaatgataccagcattccgaactttcctgaagaggcatgataagaccattgttaccaaaatgctgagcctgccagagctgctgctgtacccatcccgaagatttgaagaataccttaatcttctctacgctgtcaggcttcatacccctgcagagcatgttgaccgtggggacttgaccactgcaattgaccaaatcaaaaaatataaaggttatatagatcagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaattttgaactacttcttttggtagctgtatttcatggataatattatttagagtaatttgatgtgatgaaacctaagacagagcaagcacattgtgtaaagctttgttttatgatctaatgaaaaaagcagaatgaaagtgtttcttaagtgatcagtctagaaagatattttaatttgttggtgatttaccatttttaacattttcatgaaacaattattgatttaaaatatggataagagggctgggcatgatgactcacgcctgtaatcccagcactttgggaggctgaggtggcagattacctgaggtcaggagtttgagaccagcctcaccaacatggagaaaccccgtctctactaaaaatacaaaattagccaggcatggtggcacacgcctgtagtccctgctacttgcgacgctgaggcaggagaagaatcacttgtacccgggagtcggaggttgtagtaagctgagatggctccattgcacttcagcctgggtgacaagagcgaacctctgtctcaaaaaaaaaagaaaaaaaaaaggacaagaaatacaaatggcaatttactcaaaaacttgtcacacttatccttagtatgaatgtactcctctagagagcattaaagatataccactacaaagtactaaaaagttttctataatttttaagtgttatttattggaaggctaaattctaagaagctttaacaaatatttttgacattgttaaattagaaggctatttttaaaaagcatattttaaaaaacaaaactaaatggaaacagcaaaacttgcttgtaatgaaatacagctgagtaaaaatgtttctttgaaaacaaagacactcagaaaaacaggtgttgagtagtttcctgggcctttaatgctttaaatttattatttaacaactaaagccatactgaaagccacttggaaacttcagctgatgtatatttttacctagatattgtcaggtaaaaattgtattaatcttggaagcttgaggttgtcagtttcccttgttcttcaaattcttgtttacagtaacaaagtctatcggtgcagtttaggactgtgaatctatagtatttaaacattttttctttcagaaatgaaaatacaaaatcttctatttcttaaaactttaaatcttgttaaaaagatgaacaaaagttaaaatattatgctgttttattggtgtaaaaccacacttctgattctgccaagat

SEQ ID NO: 3178 - DNA, 2508 bp, Homo sapiens
aacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatcttt

SEQ ID NO: 3179 - DNA, 1479 bp, Homo sapiens
cgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttggctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattca

SEQ ID NO: 3180 - DNA, 3499 bp, Homo sapiens
cgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaagaaatgataggaacattgacactaatgtggaggaatttgccaaatattttatttcaaaatttagcctctgatatcataaccacaagatattttaaatcaacagtttctaagcatactaccacagtttttatgacctctccatcatcttgtggtttctagagattgacagatactatgtttgttttatagatatggtaattaatgaaacaactttaaattgtcttccattctttcttcctcagttcatttctttttgtcttcccactgatagtctttggcagctcttgaataaattctacctgttggcatcaaggggaagaaaattagcctggaaatttttatctttacataaagccaattatatagcagtttgattatgaattctaggtggaagaattagaatagtctttggaatgggttttgggtaacagccaaaatagggaaaagggtattgttaggaaagttgtcttgatattaagtatttactgtgagtccagtaagccaaaggaccaaacaaaataggttcagggtttcattttaatctcaaagattctgattcttacccatatgtcatcagttcagtttgggacatgtggtgcagcatgtgtgaagaaaatattcattaaaatgtaaaaataaacacttgaaattgtccacaacactgagcaaatattcgttataattaggatgcctacctttctgggatatttgtaaggtgctgtagtttttttaacatgctcctgaatctcctttattagttgttcttgatcatgtgacttgtaatcaggatttagaacgacaaaagcctttactacctaaaataaatatttgaaacaccagg

SEQ ID NO: 3181 - DNA, 2579 bp, Homo sapiens
gacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagcttttctataggagaaaaccaaaaggactaagtggtgccttgcaggaagtaggaatagaattctcaggacgagaacattctgtgtttgatatctgtatcctcagggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaag

SEQ ID NO: 3182 - DNA, 1778 bp, Homo sapiens
tcggtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaagggcagcagtcctggaacagcctcaggaacctcatgctaccagtcagaggaagctcagagaaaggagaacacaccgggggtcaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagt

SEQ ID NO: 3183 - DNA, 1684 bp, Homo sapiens
ccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 3184 - DNA, 1332 bp, Homo sapiens
gaaattggctgagagaaaaggtcagggtcaggaataacagtttcattatctgagcaactggacatagaggctggcacttgggcacattgtcacaaatctttgtgttgggattaatgccactaacctgtagtgttggggttccatctctgatcattatcagctaaaaatcttcaaaatgtttgtcatgcttcaggtgccctggctgcagagttgtgccaacttggtgcagattggggcacctctcccactactgggctgtttgggccagtattttgaggttctgggaagtatggaagtactggctgggcaatatgggatggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 3185 - DNA, 1340 bp, Homo sapiens
tcggtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccggggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagt

SEQ ID NO: 3186 - DNA, 764 bp, Homo sapiens
ggtgagtcggtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccggggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaa

SEQ ID NO: 3187 - DNA, 1103 bp, Homo sapiens
ctccaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaagggcagcagtcctggaacagcctcaggaacctcatgctaccagtcagaggaagctcagagaaaggagaacacaccgggggtcaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 3188 - DNA, 975 bp, Homo sapiens
gtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcat

SEQ ID NO: 3189 - DNA, 1067 bp, Homo sapiens
agcattggggctttccagctctcacagaaccttcagcatccccagctgccggtcttggcatcttcgaagtaaggagaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgag

SEQ ID NO: 3190 - DNA, 4836 bp, Homo sapiens
tacccagccctgacctagcctggtgtgggcctttccctgtgccctgtactccatcctcccagctccaggcacctggcaccctcacactgtgggagtggcttgggcaggtcctcaaggcctgtccccccacccgaccccaccccaccgcctcccatctgccctgtggcagcttatcgggtaaccagagccggcagcttcatccacgtctgaaacaggaagccccagcctgtgcatgagtcgccactgagagcccgggccagaggatggagaagcagcgggcactcgtggccgccaaggatggggatgtggcgacgttggagcggctgctggaggctggcgccctgggcccgggcatcaccgatgctctgggggccggcctggttcaccacgccacccgggctggccacctggactgcgtcaagttcttggtgcagcgggcccagctgcccggcaaccagcgggcccacaacggggccaccccagcgcatgacgccgctgccacgggcagcctggccgagctgtgctggctggtccgcgaggggggctgcggtctgcaggaccaagatgcctcgggcgtctccccgctgcacctggccgcccgttttggacacccagtgctggtggagtggctgctccacgagggccactcggccacgctagagacccgggagggagcccggccgctgcaccacgctgccgtcagtggggacctgacctgcctcaagctcctgacagccgcgcatggcagcagcgtgaaccggcggacacgcagtggcgcctccccactctacctggcctgccaggagggccacctgcacctggcccagttcctggtgaaggactgtggcgctgacgtgcaccttcgtgctctcgatggcatgagcgccctgcacgctgccgccgcccgtggccactactccctcgtcgtctggctggtcacattcaccgacatcggactcacggcacgggacaatgagggggccacggccctgcactttgcagcccgaggcggccacacgcccattctagaccgactcctgctcatgggtacccccatcctgagagactcctggggtgggacccccctccacgacgcagcagagaacgggcagatggagtgctgccagaccctagtctcccaccacgtggacccctccctgcgggatgaagatggttacacggcggcagacctggcggagtaccatggacaccgggactgcgcccagtacctgcgggaggtggcccagccggtgcccctgctgatgacgcccccaccaccaccgttccccccacctccactgttggccacgaggcgctccctggaggatggaagaagaggaggcccagggccagggaaccccagccccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 3191 - DNA, 4441 bp, Homo sapiens
atggagaagcagcgggcactcgtggccgccaaggatggggatgtggcgacgttggagcggctgctggaggctggcgccctgggcccgggcatcaccgatgctctgggggccggcctggttcaccacgccacccgggctggccacctggactgcgtcaagttcttggtgcagcgggcccagctgcccggcaaccagcgggcccacaacggggccaccccagcgcatgacgccgctgccacgggcagcctggccgagctgtgctggctggtccgcgaggggggctgcggtctgcaggaccaagatgcctcgggcgtctccccgctgcacctggccgcccgttttggacacccagtgctggtggagtggctgctccacgagggccactcggccacgctagagacccgggagggagcccggccgctgcaccacgctgccgtcagtggggacctgacctgcctcaagctcctgacagccgcgcatggcagcagcgtgaaccggcggacacgcagtggcgcctccccactctacctggcctgccaggagggccacctgcacctggcccagttcctggtgaaggactgtggcgctgacgtgcaccttcgtgctctcgatggcatgagcgccctgcacgctgccgccgcccgtggccactactccctcgtcgtctggctggtcacattcaccgacatcggactcacggcacgggacaatgagggggccacggccctgcactttgcagcccgaggcggccacacgcccattctagaccgactcctgctcatgggtacccccatcctgagagactcctggggtgggacccccctccacgacgcagcagagaacgggcagatggaggtgcccctgctgatgacgcccccaccaccaccgttccccccacctccactgttggccacgaggcgctccctggaggatggaagaagaggaggcccagggccagggaaccccagccccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 3192 - DNA, 3610 bp, Homo sapiens
gcggtgtgccgcaggctctcccatcgaccaggcgggggcgggccccactgactccccagagaaggtccagtggggcccccgaggtgttctggggcagggtgggctggggtcagctcccagctcgcagatcgttcaggagccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 3193 - DNA, 476 bp, Homo sapiens
gtgccgcaggctctcccatcgaccaggcgggggcgggccccactgactccccagagaaggtccagtggggcccccgaggtgttctggggcagggtgggctggggtcagctcccagctcgcagatcgttcaggaggtcagctctgcccccagggccggatccccgaggctctgggtctctgctccccagcccttgccctttctgcaacacccttcttcttcttggcagccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagc

SEQ ID NO: 3194 - DNA, 8101 bp, Homo sapiens
ctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcttttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaacatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattttaaggtcacgtcctatagtttgggggcccttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggatcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttt

SEQ ID NO: 3195 - DNA, 504 bp, Homo sapiens
aaaggttaaagaaagagggaccaattaacttcaccttttcctaaacttgaaaagacaaaccaaattctgcccttcatctccaatgtttgaaagatcagaggttcctgtcaatacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggt

SEQ ID NO: 3196 - DNA, 1010 bp, Homo sapiens
agtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaatttttttgttgttgtattaaaccatgtacgttgcagcttaacaataaaaaaaaatctatgaatctttgtgagcaattatgctcccaaatctaagcaagtaaaatacacattttgtctttcttaa

SEQ ID NO: 3197 - DNA, 3085 bp, Homo sapiens
agtcggcgcttcccggaagtgacgcgaggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaa

SEQ ID NO: 3198 - DNA, 3096 bp, Homo sapiens
cttctctctcggcgtttccgctgtcagggccctgcggtgtgactcgcgggctcagctggttggtattttttgggcctcgtgcttcgtggtgggagacccaggtcgaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctc

SEQ ID NO: 3199 - DNA, 3053 bp, Homo sapiens
ctctctcggcgtttccgctgtcagggccctgcggtgtgactcgcgggctcagctggttggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaaga

SEQ ID NO: 3200 - DNA, 2396 bp, Homo sapiens
tctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcct

SEQ ID NO: 3201 - DNA, 2868 bp, Homo sapiens
ctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 3202 - DNA, 1974 bp, Homo sapiens
gttgggagttgagggagggggacaacgcggcgtgtgaagagtggggaagaaatcacgcgactggatttggagttctgctgggctcgaatctcagctgtgctttttattaaccgtgggaccttgagctactcggctctcctttctgaatgacagtttcctcctctgtaaaacaggaatggttaattcaacgaatgtttactgagcgcttagtccagtggtgcaggtttaaggctggaggcagcggaaaaggaaaacaaggttcctggtctcgggaagcttaccatgggggtgtctgtacgcgtgtgtgttcgtgcgctcagtggtggaagacaggacagaaaataaacggatcaacatccaaagcaacaaggtcattacagcttatggggaaactgactcgatgaagctcaggcctggccgcggtcagggtagaatcaggactagaacccaggctgtgtggctgcagccctgaccctcaccatccaggtcaggcagagaacactcaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaaggtggacactgtggaggacttctgggcgctatacagtcacatccagctggccagcaagctctcctctggctgtgactacgccctcttcaaggatggcatccagcccatgtgggaggacagcaggaataaacggggtggccgctggctggtcagcctggccaagcagcagcgccacattgagctggaccggctgtggctggagacgctgctgtgtctgatcggggagagctttgaggaacacagcagagaggtatgtggggccgtcgtcaacatccgcaccaagggggacaagatcgctgtgtggacgagggaggcggaaaaccaggcgggcgtgctgcacgttgggcgtgtatacaaagagcgcctgggcctctccccaaagaccatcattgggtaccaggcccatgcagacacagccaccaagagcaactccctagccaagaacaagtttgtggtgtgaggggggccttggcacccctcctatgtaatgggacagccgccactgagcctcattactttgggggatggggcgggactggggatcagacagcctagttcttacctgtcctcaagtgaacaggaatgcaaacactctttaacatgagttggggcctgagccttaggggctagatgggggtagtggtggcagtctgaggacctagcttgtcctggggccacaggacagcagcagggtggaaaaaactcctgagggtggggtgagtcatggcggggaaggagggctctatggtaggcggagaaacccatagtccagcgtttactgtttccacccaggaaggaggtgaggtggcctgagagacagactcttccatgggtggtgggctcaagggcacagacattctggagggtgaacgccatcatttgtacagagggatacgtgggttgctgaggactgagagagccttgcaaggccgctccccttctccccagctgtgaccagggctgtctgggccttgcctgcctcagggccagactgaagtggaggtggagggatgctgggctaggcctcaccaaggttctggtagaagtggtggaagtggataaacttgataataaaagcttaagcatctttctgttcctgttttaaataaatacttctgaac

SEQ ID NO: 3203 - DNA, 1676 bp, Homo sapiens
aaggctgtgggttgagcaaatactcagcctccagatggtcacgagccccccaagtgtgggggaggagcagggccttttatacgtctgggaccctaaaagtgcccaagatggggaaactgactcgatgaagctcaggcctggccgcggtcagggtagaatcaggactagaacccaggctgtgtggctgcagccctgaccctcaccatccaggtcaggcagagaacactcaggtggggcaggaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaaggtggacactgtggaggacttctgggcgctatacagtcacatccagctggccagcaagctctcctctggctgtgactacgccctcttcaaggatggcatccagcccatgtgggaggacagcaggaataaacggggtggccgctggctggtcagcctggccaagcagcagcgccacattgagctggaccggctgtggctggagacgctgctgtgtctgatcggggagagctttgaggaacacagcagagaggtatgtggggccgtcgtcaacatccgcaccaagggggacaagatcgctgtgtggacgagggaggcggaaaaccaggcgggcgtgctgcacgttgggcgtgtatacaaagagcgcctgggcctctccccaaagaccatcattgggtaccaggcccatgcagacacagccaccaagagcaactccctagccaagaacaagtttgtggtgtgaggggggccttggcacccctcctatgtaatgggacagccgccactgagcctcattactttgggggatggggcgggactggggatcagacagcctagttcttacctgtcctcaagtgaacaggaatgcaaacactctttaacatgagttggggcctgagccttaggggctagatgggggtagtggtggcagtctgaggacctagcttgtcctggggccacaggacagcagcagggtggaaaaaactcctgagggtggggtgagtcatggcggggaaggagggctctatggtaggcggagaaacccatagtccagcgtttactgtttccacccaggaaggaggtgaggtggcctgagagacagactcttccatgggtggtgggctcaagggcacagacattctggagggtgaacgccatcatttgtacagagggatacgtgggttgctgaggactgagagagccttgcaaggccgctccccttctccccagctgtgaccagggctgtctgggccttgcctgcctcagggccagactgaagtggaggtggagggatgctgggctaggcctcaccaaggttctggtagaagtggtggaagtggataaacttgataataaaagcttaagcatc

SEQ ID NO: 3204 - DNA, 581 bp, Homo sapiens
aagcttaccatgggggtgtctgtacgcgtgtgtgttcgtgcgctcagtggtggaagacaggacagaaaataaacggatcaacatccaaagcaacaaggtcattacagcttatggggaaactgactcgatgaagctcaggcctggccgcggtcagggtagaatcaggactagaacccaggctgtgtggctgcagccctgaccctcaccatccaggtcaggcagagaacactcaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaag

SEQ ID NO: 3205 - DNA, 4449 bp, Homo sapiens
gtgaggtgccggcggctggcggccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaaccctcatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctgaggtgttggcggggcggtcgcagacttcagggtcccctaacggaaaggccaggctccgcgtggacggccaactccctgcccgctccttcagcaggtgactgtctctgccacttcttacctgctgaaggatcttgctcagtagctggaacaatgctgctgtcacacagtctcttctctgaaacttcaggatgctccttggtcaccaggcaatgggagctgtagaccagccgcatgcacttgccccacattcactgctgactggcttcactggaataggttcaggtcaccgggacttctctcagagtcagcggcccacccaactccctcataccgtcgcatctgaaaattttcagagaggaattctctttgtagtcggcttgtcagggttttcaagtttttctatggttatttttaaatctctttttttaaatgctaaaattaatgtcctcattaatgcaagtaattttagagcacagtgtagccatgtacagtttccattatttaaaataaataaatgtgttggttcatttggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttga

SEQ ID NO: 3206 - DNA, 720 bp, Homo sapiens
gtgaggtgccggcggctggcggccgcggagtcttcggcgagacctaccgggccctgtctgtgccggccgtgagctgcggcaggacggctggagtaaatcttggtgccaataatggaacgaacactggacacaggactggggaagactggatttcagcttaggagaagaatactaagaagtttcagcagtggaatgcctactcttcttataaccggagtggaaacggaagcattttgtgagagggctggagggaagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaa

SEQ ID NO: 3207 - DNA, 1835 bp, Homo sapiens
gcggaagtgaggtgccggcggctggcggccgcggagtcttcggcgagacctaccgggccctgtctgtgccggccgtgagctgcggcaggacggctggaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttc

SEQ ID NO: 3208 - DNA, 1706 bp, Homo sapiens
ccccagagaggtcctagggctggtggacatggccgccctggagaatggggagctggggccccttctctcccctggcaccctgcggggtttggaggatgaatgcgtcacagatgttaaggctcagacccgggctgcccttctccgtgtgctgcaggaggacgaagagcactgggggagcctggaggaccagcccagcagcctggcccaggatgtgtgtgagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgccgtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 3209 - DNA, 1719 bp, Homo sapiens
acaatcaggtctaccccagagaggtcctagggctggtggacatggccgccctggagaatggggagctggggccccttctctcccctggcaccctgcggggtttggaggatgaatgcgtcacagatgttaaggctcagacccgggctgcccttctccgtgtgctgcaggaggacgaagagcactgggggagcctggaggaccagcccagcagcctggcccaggatgtgtgtgagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgccgtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 3210 - DNA, 2293 bp, Homo sapiens
cccacagggccacaacaggtttctgcatctgctcctatggccactccttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccagcaggcatccactggggcagcgtctgaggaactgaaacccgaggcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgcgctggccgagctggcccgcgtggtgagcgcggaggaggaagcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatgctcgtggccgagcacgtgaaggcggccggcgccatctccgcggagctggaggccaccaccctgcgaatctgcacgcgggcgctcggcctcttcgtgcccaggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacactcaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtc

SEQ ID NO: 3211 - DNA, 2942 bp, Homo sapiens
gcggacctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatggaattttgctgaataatgtctttgacacacaggtagcagatgtacttcagttttccatggaaacgggtggctatcttccaaactgcatcactactttgcaggagagtttaatcaaacaccttcaagtagcccctaaatatctctcctttctagaaaagagacaaaaactaattcaggaaaatccagaagtatggttcatccgacctgtttcaccctctttactgaaaattttggccctggaagctacctacctgttaccccttcgcttggcactcctagatgagatgatgtctgacctaaccaccctggtggatggttacctaaacacgtatcgcgaagggtctgcagaccggcttggaggcactgagcctacatgtatggagctgccagaggaactgcttcaactcaaggacttccagaagcagcgcagggagaaagctgcaagagaatatagggtgaatgcacagggactcctgataaggacagtgctacagccaaagaaattagtgacagagacagcagggaaagaggagaaagtcaaaggcttcttatttggtaaaaattttaggatagataaagctccaagttttacatctcaagactttcacggggatgtgaatttactgaaagaagaatctttgaataaacaagctacaaatcctcaacatctacctcccacagaggaaggggaaaccagtgaggattccagtaacaaactcatttgcacaaagtcaaaggggtcagaggaccagagaataactcagaaagaacactttatgacacccaaacatgagtttcaggcaagtttatctttgaaagaggagacagaacagttattgatggtggaaaacaaggaagatttaaaatgcacaaaacaggctgtttcaatgtcttcctttcctcaggaaaccagagtgtctccaagtgacactttttatcctatcagaaagactgtggtttccacactccctccctgtccagccttggagaagatcgattcctggataagtccttttctaaatctgccctagagatgggcagtttgttcttaaggccatacagatggcttatttcctttgccatcagggctttccacagtgcccaggtttctcatgttgtaaatgtagtaatgcttcagtcacaggggaaaattatatcctcttgcttactcctgtgttcctggtatgcggagaatgagaatgaataagttaaataatggaagaagtataatttctgattatgtcactgtgtagaaatgttctcagtgaccagagtgcattatttttcataatttgggtttagaggatttgaagaaaggaagaatcttgggcttagtatcaggaagactccatcattttcaaattttgttttgcttcttgacttttggattcctttgaagagacctggtaaaactattaacaattcatttaaaaaattggtacctgataactttaccagtacttttttcctttttatttatttgttttatttatttttttttaccgctccttgtggagcagggctacaccataggcagtgtgcccagagtaaccacttttttcctttttaaaatataatattaactttatgtttgaatgttgaatgttttgtctgtctcttaggcaaataatgttataggaatcaataatttaatttttgttttatttgttttttgatggagtctcactctgtcacccaggctggagtgtagtggtgtaatctctgctcactgcaacctccgcctcccgggttcaagcaattctcctgcctcagcctcctgagtagctgggattacaggtgcgtgccaccacgcccggctaatttttgtatttttagtagagatggggtttcaccatgttggccaggctggtctcgaactcctgactgaccttgtggtccacctgcctttggcttccaaagtgctgggattacaggtgtgaggcacggtgcccagccaatatctttattttaatttgtttttatttcctttatttttagctggttttgtccattttcctaacaaagcagggaccctgggtttctttttagtctgtctgttatataaacttgaagcctgactccattctatttgcctggagttagtatactttcttagggtgaaaggaaggcagcttgtattgagccttttaaagtattgaatgcttgcaaattgctaacattcttttgtgtaaaataaccaataaacctgttttgtcatactctacttaaaaaaacaa

SEQ ID NO: 3212 - DNA, 2177 bp, Homo sapiens
ctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtgtttggatgcttaaagaagattatttgaagacggcttttggaatcaattagcatggaccccagcagtgactaccatttcctcagccagattttgtggaagagggtgaaactcacattggtctgtggtgtcttcgagggtgtgcttcagcatgttgaccctaataagattgttgtcctgaagaaagtgaagaatgtggagacaggtcgaagtgtcccaggagtgaagttgttttttgggcatgagattgtgaatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatggaattttgctgaataatgtctttgacacacaggtagcagatgtacttcagttttccatggaaacgggtggctatcttccaaactgcatcactactttgcaggagagtttaatcaaacaccttcaagtagcccctaaatatctctcctttctagaaaagagacaaaaactaattcaggaaaatccagaagtatggttcatccgacctgtttcaccctctttactgaaaattttggccctggaagctacctacctgttaccccttcgcttggcactcctagatgagatgatgtctgacctaaccaccctggtggatggttacctaaacacgtatcgcgaagggtctgcagaccggcttggaggcactgagcctacatgtatggagctgccagaggaactgcttcaactcaaggacttccagaagcagcgcagggagaaagctgcaagagaatatagggtgaatgcacagggactcctgataaggacagtgctacagccaaagaaattagtgacagagacagcagggaaagaggagaaagtcaaaggcttcttatttggtaaaaattttaggatagataaagctccaagttttacatctcaagactttcacggggatgtgaatttactgaaagaagaatctttgaataaacaagctacaaatcctcaacatctacctcccacagaggaaggggaaaccagtgaggattccagtaacaaactcatttgcacaaagtcaaaggggtcagaggaccagagaataactcagaaagaacactttatgacacccaaacatgagtttcaggcaagtttatctttgaaagaggagacagaacagttattgatggtggaaaacaaggaagatttaaaatgcacaaaacaggctgtttcaatgtcttcctttcctcaggaaaccagagtgtctccaagtgacactttttatcctatcagaaagactgtggtttccacactccctccctgtccagccttggagaagatcgattcctggataagtccttttctaaatctgccctagagatgggcagtttgttcttaaggccatacagatggcttatttcctttgccatcagggctttccacagtgcccaggtttctcatgttgtaaatgtagtaatgcttcagtcacaggggaaaattatatcctcttgcttactcctgtgttcctggtatgcggagaatgagaatgaataagttaaataatggaaga

SEQ ID NO: 3213 - DNA, 3228 bp, Homo sapiens
gcacaggttccaggtctttaacgtgagcccgctgcaggtgtgcggcccagtccgagacagcagattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagc

SEQ ID NO: 3214 - DNA, 2496 bp, Homo sapiens
gcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgc

SEQ ID NO: 3215 - DNA, 3404 bp, Homo sapiens
acaggttccaggtctttaacgtgagcccgctgcaggtgtgcggcccagtccgagacagcagatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggaacgtcatggtacctacctccagtggcttttctaaggattcaaatagatcacccccataaaggattcagcacagtgtgaacatatagtagtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcac

SEQ ID NO: 3216 - DNA, 3252 bp, Homo sapiens
gggtgcgcgcaggcggccgcacaggttccaggtctttaacgtgagcccgctgcaggtgtgcggcccagtccgagacagcagattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaa

SEQ ID NO: 3217 - DNA, 2496 bp, Homo sapiens; identical to SEQ ID NO: 3214

SEQ ID NO: 3218 - DNA, 2828 bp, Homo sapiens
gcccgctgcaggtgtgcggcccagtccgagacagcaggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaa

SEQ ID NO: 3219 - DNA, 2688 bp, Homo sapiens
ccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttagg

SEQ ID NO: 3220 - DNA, 1143 bp, Homo sapiens
gcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggaacgtcatggtacctacctccagtggcttttctaaggattcaaatagatcacccccataaaggattcagcacagtgtgaacatatagtagtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccag

SEQ ID NO: 3221 - DNA, 2831 bp, Homo sapiens
tgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagca

SEQ ID NO: 3222 - DNA, 2872 bp, Homo sapiens
acttccgccgggagctttgtgcgcccggcttcctcgccccgcccgcgctggccttggtgcgccggataaagccctccgggccagcggctgcggtcgggccaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacggtaccctgaggtgacctccttgagcctggagaagctgagtccgaaggcgctgagcaggcaggtcttgcgtctgcaggagcggtacggcgtagccccagcgctgtgtcccaacgcggccattcagcagcgcctggcggccctgcggcacctgtgccacaagcggtttgtggagaagagcctgtcacaggagaactggaccgaccatgtgcagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggtccctgtggctgtggctgtgtctgagggcgctgcccctcagattccggccagggccttccgtgtggtgtgtgacaacatgctgcaggggctggcacggagcctccgctgtctcggtgtggatgcacgcatgctgggcaatggtgaagaccaccgcagggcggccgaggttgccaggcaggaggggaggatcattctgacgtcggggcagccattccacaagctccgggcccaggtcggggctgggcgctgcctctcggtcgactgctccctgaaggcccagcagcaggccaaggctgtgctcaagcatttcaacgtgcgtgtcacccacgcagacatcttcagccgctgccaggcctgtaactgtgaccagtacctaaaggtctccagggacatgatgaagcagctcatgtggctcagcagtcaccaggaggggcccaggagctcaggtgacgaggccacccagagccaggcggtgcaggagccaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggccc

SEQ ID NO: 3223 - DNA, 2755 bp, Homo sapiens
acttccgccgggagctttgtgcgcccggcttcctcgccccgcccgcgctggccttggtgcgccggataaagccctccgggccagcggctgcggtcgggccaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacggtaccctgaggtgacctccttgagcctggagaagctgagtccgaaggcgctgagcaggcaggtcttgcgtctgcaggagcggtacggcgtagccccagcgctgtgtcccaacgcggccattcagcagcgcctggcggccctgcggcacctgtgccacaagcggtttgtggagaagagcctgtcacaggagaactggaccgaccatgtgcagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggggctggcacggagcctccgctgtctcggtgtggatgcacgcatgctgggcaatggtgaagaccaccgcagggcggccgaggttgccaggcaggaggggaggatcattctgacgtcggggcagccattccacaagctccgggcccaggtcggggctgggcgctgcctctcggtcgactgctccctgaaggcccagcagcaggccaaggctgtgctcaagcatttcaacgtgcgtgtcacccacgcagacatcttcagccgctgccaggcctgtaactgtgaccagtacctaaaggtctccagggacatgatgaagcagctcatgtggctcagcagtcaccaggaggggcccaggagctcaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggcccatggccgtg

SEQ ID NO: 3224 - DNA, 5960 bp, Homo sapiens
agtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagt

SEQ ID NO: 3225 - DNA, 2088 bp, Homo sapiens
tgtgtctttgttaggagatttcataccatgttaatcattatggaaacactacttaagagaatatggctgaaatatgtttgggtttttaaaaatatctttcttacagactaatattgtctgtggacctttctacatttgtttgtttgtttttgaaacagttttgtcacccaggctggagtgcagtggcgcgatatcagctcactgcagccgcctcctcccaggttcaagcgattctcatgcctcagcctcttgagtggctgggactacaggtgcgcgccaccatgcccaactaattttttgtatttttagtagagatgaggtttcaccatgttggccaggctggtctcgaacccctggcctcaggtgatctgagcctcccaaagtgctgaaattacaggcgtgagccaccccacctggcccctttctacattttctaagttcctatctctgaggacaaagggtcaggagcgtagacaacgtagaaaggttctgcagacatgatcctagttatgccagtgtttccaccctgtgttttgcaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatatt

SEQ ID NO: 3226 - DNA, 6038 bp, Homo sapiens
atgaccgcaaacagggacgccgccctctcatcccaccgccaccccggctgcgctcagcggccgcgcacccccacgtttgccagcagctcccagaggcggtcagcctttgggtttgacgacggcaacttcccgggcctcggcgagcgcagccacgcacccggaagccgcctcggggcgcgacgccgagccaaaaccgcccgcgggctccgaggccacaggcaaaggggcgctggcgcggggctgagccgcccgggatcagcgcgagcacccagcccgcctcggccgggagcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctc

SEQ ID NO: 3227 - DNA, 2178 bp, Homo sapiens
agtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccagccacatctcagtcaaggagccgacccccagcatcgcctcggacatctcgctgcccatcgccacccaggagctgcggcaaaggctga

SEQ ID NO: 3228 - DNA, 2090 bp, Homo sapiens
tgtgtctttgttaggagatttcataccatgttaatcattatggaaacactacttaagagaatatggctgaaatatgtttgggtttttaaaaatatctttcttacagactaatattgtctgtggacctttctacatttgtttgtttgtttttgaaacagttttgtcacccaggctggagtgcagtggcgcgatatcagctcactgcagccgcctcctcccaggttcaagcgattctcatgcctcagcctcttgagtggctgggactacaggtgcgcgccaccatgcccaactaattttttgtatttttagtagagatgaggtttcaccatgttggccaggctggtctcgaacccctggcctcaggtgatctgagcctcccaaagtgctgaaattacaggcgtgagccaccccacctggcccctttctacattttctaagttcctatctctgaggacaaagggtcaggagcgtagacaacgtagaaaggttctgcagacatgatcctagttatgccagtgtttccaccctgtgttttgcaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatatt

SEQ ID NO: 3229 - DNA, 3845 bp, Homo sapiens
tacgttggtctcccaaagtgctgggattacaggtgcagctgccttggcgaccatttgtcctacagtttgtccggacccaggctgtccttctgtgtgctggaatgaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 3230 - DNA, 3742 bp, Homo sapiens
gaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 3231 - DNA, 2833 bp, Homo sapiens
ctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggaatctgaacctgtgatgttaagaaatcagtaaatattaaaaagaagatggatgcaagaaggatgaagaaagaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatt

SEQ ID NO: 3232 - DNA, 1412 bp, Homo sapiens
gcgaggcgcggtgagtcagagccgcacagtaaatatttgtattagccggagccggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaacca

SEQ ID NO: 3233 - DNA, 1588 bp, Homo sapiens
aggattcgaatcgaacgtccttacgggagccgggcgctggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagttgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaa

SEQ ID NO: 3234 - DNA, 3621 bp, Homo sapiens
agtccagcgtctctccccctggctcccggctgtgcgctgaggctttgtcccctgtcctttggcgaaggagtggagtttgaccccttaccaccaaaggaagtaaggtacacctccttggtcaagtacgactccgagaggcacttcatcgacgacgtgcagctgcccctgggcctggcggtggcctcctgcagccagacggtcacctgtgtccccaatggcacgtggcgcaactacaaggccgaggtgcgcttcgagccacgccacaggcccacccgcttcctcagtaccaccatcgtgtaccccaagtaccccaaggccgtctacaccaccaccctggattacaactgccgcaagacgctgaggaggtttctgtccagcgtggagctcgaagccgcggagctcccgggcagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaagaaaaaatcactgcatctcataattattgagatctttgtgttgtaattttcaagctgtttttagagggaatatatgtcctggtttgctgctgtgttgtttccccaaagtctcaatcagatgaggcaacaaaaagaccaccagaattgcaggaaagcagcagcagtctgggatagggaggggggaggagagctctccctccgtggtcagtttgtcagaagaaaagcatggaaaaagtgagatttaagaaatctcagccacgggtgtcttcactgcacaaaagtggtgctaattcagtaaacagtgacacctgtgtgggttcaatctgtggagagttgagttccattcctttgtttttaaatttccacctccatttgtgtttcctattaacctaaactcttgtaattctctaaatcttttttcatgatataaaaaaaaaagaaaatcccaaaccacaatttaagatgccttttttttttaaaaaaaaaggttctccgtgttgccacctgctccgggaaggccaggccgatgggcggccaggtttgggagcagcggcttcggctccgattgcttcctgacggtcagttccaagcacaggctctgagaaacgcctcgaacccttggtatctggtgaccgtctccgcaggcttccgtgagtctccgataggtgttttgggcttttggaatactttcagaatactttcccattttttcataaggcaaaacggagtggacggcctttttttgagagaaacagcattctaagagtgtgcttggaaaacacactttttgggagtccacgtggggagtggacactcaggacaggaagcggtggccctaagacctgcggccacccggaggaggcagacgcaggcgatgacctggttcatcatgagaggagctagagttgactcagtcttaggatctcgatggcgtcagaattgcagagggtttctgccagtgccttaggtctaattcagaaagcaaggaaggctgggcacggtggctggcgcctgtagtctcagctacttggaaactgaggcaggaggatctcttgagcccaagaattcgagaccggtctggcaacatagtgagcctccatctctaaaaaaaagtggcaaagctgaggaaatctgtgcccccatcccccgacaccagacaagctaaggtgcattcagagtagggaacgatgtcaaaacctggccgccgtggtggcgcgcattcctctcacaccaccgtacggaggcaggtgacagtcaactgaaatgtccccaaggaccgtgtgaattcggctggcgtggcccagcagcggggtggaccagggtgcggtggcttcagacctgcctcccgccaccccgtcctcccctaaccccttcttgggacctcctgccaatccctgtggtgtttgagtaaagaaagtggctgatggttttacttttttcttccaatattggaaagaacaaactagatattccccttgaacacatccaaattatttccagtgcctgagggttaccgagcactgtaagctcagctcggctgtagctccgggtttctgccgatggcctccatctgcgccgaaagctgaactgagccccgcggtgccccggagccacagcagcaggtgcagcgacaatcgccgtcgtgcgcagtcgctggagtcctggagagccacgctgtcctctgcagacaacagcatcagtccgctgtgccccaatgcatcgacgccctgtggacggggcctgcagtccacccgtggtctgagcttgccgggctgaagctcggctgggacccagggaggggccaccctgggacccacagtctcctcagtcacgtgcagagcaaaaaatgcttcctgtgtttggaagagcaagtgacgcagcatttattgataaaaatggatttttctgtctgatttcatgctgtggtcgtttaagtggtcaatgtcttttttttttttttttttgacatggagtctcgctctgttgcccaggctgagtggaatggcgccaactcagctcactgcaaccttcacctcccaggctcaagcgactctcctgcctcagcctcctgagcagctgggattacaggtgcccaccaccacgcccagctaatttttgtatttttagtagagacggggtttcaccatgttggccaggctggtctcgaacacctgaccttgtgatccacccgcctcggcctcccaataatttgtaagttatgttagcgggatcctcaaggccttgctttgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtgtagagagtgtgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggctttcatgtaataaggatatttttagtgaaaaattgttttcctttcaaattacagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatctgaaaaaacaaaa

SEQ ID NO: 3235 - DNA, 2148 bp, Homo sapiens
acactcagtctctgattttatccctgccctggcttaattaagtgctctgaagacataaataggttttttgtttactcaagcttgggagaagctggcagaaaaggccttttcagctaaaagctccttacagccggaaggtgtgaagcggcaagtttccagccgggaagaagcctctcagccgtaggcgtctttgcccggagctgtgagcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 3236 - DNA, 652 bp, Homo sapiens
cagaccaagccagggccagagggtgtcaggtggtcctgtgtgcccagcagggagctgaggccactgcaacaaggggctgcataaccccgtgtccctggctctccccacagcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcagga

SEQ ID NO: 3237 - DNA, 2148 bp, Homo sapiens
atggtgggccacctgcatctgcagggcatggaggacagcctgaaggagcagggccgggagggcttgctggacagccccgactccgggctgccccccagccccagccccagcccgcccttctactccctggcgcccggcatcctcgacgcgcgcgcggggggcgccggcgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 3238 - DNA, 1929 bp, Homo sapiens
gtgcgggtaaccgagacgccagtactagggctgtggtggccctcctccccatcgattgtccccgggcgcgcagctctcgccccgccgccgcctgccccgggccccggagcgcggtggagaagcccccggaggagcggggggcccgcgccccgcgccccccagacatggtgggccacctgcatctgcagggcatggaggacagccgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccgctggttcaccgccagcgtgcagctgcagctttgccaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaaccc

SEQ ID NO: 3239 - DNA, 2057 bp, Homo sapiens
cccagccccagccccagcccgcccttctactccctggcgcccggcatcctcgacgcgcgcgcggggggcgccggcgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatggagtgcccttgaagcagagaacagccccgagcagtgtgaggacagaggcatcccagcctcagccggtggggacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggcggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcactccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaa

SEQ ID NO: 3240 - DNA, 3621 bp, Homo sapiens; identical to SEQ ID NO: 3234

SEQ ID NO: 3241 - DNA, 5600 bp, Homo sapiens
tcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaagcctgctttttctttcagaacaccccagcggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagttta

SEQ ID NO: 3242 - DNA, 1145 bp, Homo sapiens
ctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagttttcttaattctggatctttgatt

SEQ ID NO: 3243 - DNA, 1568 bp, Homo sapiens
gtcaggtggttgtcggattttagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagtttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactcccaa

SEQ ID NO: 3244 - DNA, 1109 bp, Homo sapiens
gttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtagcaattttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtagg

SEQ ID NO: 3245 - DNA, 1170 bp, Homo sapiens
tttccggccggtaccagtccgagctctggtccccacggtcatcacgctttgctttctcagccaagatctcggggctcagggcggaaacgcagcggatatgtattttcttccggggttggtggcgctcggctctcatgacctgcaggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttat

SEQ ID NO: 3246 - DNA, 712 bp, Homo sapiens
tccgagctctggtccccacggtcatcacgctttgctttctcagccaagatctcggggctcagggcggaaacgcagcggatatgtattttcttccggggttggtggcgctcggctctcatgacctgcaggtgacagtgttggccggtggcgcggccctgcttgcctcgtgccccgcccttcgtgcttgaaaaaaaatcccgcgaagccttctccgaaagaacatgctggttctttggttgaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttg

SEQ ID NO: 3247 - DNA, 2798 bp, Homo sapiens
ggtgcggttgggatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatacttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattca

SEQ ID NO: 3248 - DNA, 2865 bp, Homo sapiens
agtcggtgcggttgggatggtgccactgcgcagccgcgagagggcggtaccacggcggcagcgacatgggggggcgcggagcagacgccggaagtagtggtggtacgggtccgactgaggggtactcgccaccggctgcgtccacccgagcggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggaaaaggagaaggaatggcaacgaagaagacaaccatcttcccccccagaccaaaagaagtagcagaaaccctgtctttcaggattcctgggacacagagacagtacctgtaatgagaaacagtaaagaaaacagactaagaggaaacaaagcgttctgcgcgtcttcaggcagtgacagtggtgggagcagcagcagcagcagcagcagcatcaatagcccggacagggccagcgggccggaaggcagcttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttattcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttttaaagccagatacttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattca

SEQ ID NO: 3249 - DNA, 1067 bp, Homo sapiens
aacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttactctc

SEQ ID NO: 3250 - DNA, 1179 bp, Homo sapiens
cggcggacccagaggaaacaggagccgacctccccgggctccgatgcgcaggcccagagcccgtcaatccttggccagccccgccctccgggctgcgtttttccggcggcgcaggaacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttactctc

SEQ ID NO: 3251 - DNA, 1229 bp, Homo sapiens
aacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtaggaaacactgcacaattctgtcagataagaaatatgtaatattttgtcttaaacaaaaatttattacgttagcacattatgtgatctcataattccatctattatgtatagag

SEQ ID NO: 3252 - DNA, 3597 bp, Homo sapiens
cccgccctccccagcccgcctcagggaagcgagcccgggcgccggcgggcggccgtcgcgtctgacagaccactgcagaccacgggccgaggcccagcgcccgtccgcagcgcggccggcatggcggcgacaaggagccccacgcgggcaagggagcgggagcggtctggcgctcccgccgcaggaagtgaccaagttcactcctggatgctagctacaagccaagccttagacactgtctggagaatggcaaaaggctttgtgatgttggcagtttcatttctggtggctgccatctgctacttccggaggctacatttatattcagggcacaagctgaaatggtggattggatatctgcagagaaaattcaaaaggaacctcagtgtggaggcagaggttgatttactcagttattgtgcaagagaatggaaaggagagacaccccgtaacaagctgatgaggaaggcttatgaggagctattttggcggcatcacattaaatgtgttcgacaagtaaggagagataactatgatgctctcagatcagtgttatttcagatattcagccagggcatctcttttccatcatggatgaaagaaaaggacattgttaagcttcctgaaaaactgctgttttcacaaggttgtaattggattcagcagtacagttttggtcctgagaagtatacaggctcgaatgtgtttggaaaactacggaaatatgtggaattattgaaaacacagtggactgaatttaatggcattagagattatcacaagagaggaagtatgtgcaacacccttttttcagatgccattctggaatataaactttatgaagctttaaagttcatcatgctgtatcaagtcactgaagtttatgaacaaatgaagactaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctgcactgatacatttgggagttggtggcttgactttgtccataaggggcgtggccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcttaatagttttatttagattttttaaaattctgtagattaaagcaaatgacagttattgaactatcacaaaactattaaactgtggtacatttaatgtgtatttaatgtgtggaatctcattatggtaggcagaataatgccctatgctccccaaagatgtctgtgtctgaatcctcagagccgtaaagggctaaatgggttaaatgggaaaggagaattaaggttgcaggtggaactgagatgctaatccaatgatgctgaaatagggagatttttctagattctccaggtggacgcagtgtaatcagaatggttcttaaaagtggaagagggaattggaagagtgtcagagtcagaggggaatgtgaaatatggaagaacggttagagagagatgcaccattgctggctttgaagatggaggaaggggccataagccagggagttgcaggcagcctgtagaattgagactggaaaggaaacagaaacttccccatagcctccagaaggaacgcagccctgccaacaccttgattttagcccagtgaagcctgtgttggacctctaatctgcagaactgtaagataatagatttgtgtttaagccactaagtttgtggtaatgtgttgtagcaacagaaaactagtattctcaggctagtttttggtcgtctttattttggaaatacttttctagtttaatttgatagttttttttttggaggtactttgctagtctgttttgagtttcagtacataagaataatttttaaaatcttgctaattatatattacttcaaagtcacaaatccctttctaagaatgacttacttcacgagatatttagcactatcattttcccagatgttcatattatttctgcaataaattaaaagggagtgtgtcaaatgctgtcatgtctgaaattagcattcatattcttttgcaatggggatgatcagtcgtgtgtactacatgaaccatgtctgatggtagcttgttcccactgtcattttgttttctggttgaagattaatgagctcagccacagaaacaagagttcttcattgacctctacagtccctgcctgtttggaaacatctatggttttgtataacccctgtcatttaactgacagtgttagaagatatccccctgatgtgttactgtaaccaagaaagcatgaacgttaccctttctggtgacagcctgccatgggctgctgtggctgatacttatagaattgttgctccaaaattttggctccacttgagctgtccagaagtgtacctgacatttgtgtattaccactcaccttggatctccttactagtgtaattatttccacatcaatccaggactgaaaggaaaaattttttcaccaggattggcagcctgtagctctgtgacctcagtcaacccatcatgttgtgttgtgggcggggggcaagaattctttagagaaccaagttgcgagaaagatttcaatccagtgaaagtaaaaagtaagaagacatttagatagttgctatattttgggaagatgtcaaaacaggtttttagggaggaggtatgaggtgttgtgttgttttgtttgtttttattcagttgtataatgaatataacaaattaagtagccagaaggagctgcatgtaaattagcaccacttttaaatgtcaacaataaatttgaggtgagcttcctgggtgatgccaacatttaaa

SEQ ID NO: 3253 - DNA, 7800 bp, Homo sapiens
gccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgataagattttctttgcttaaggagaacggacattgccttggtatgtttttttttttttttccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacctttaatgatacagcacttctgccatctcagcatctacataggacttacatagacttcctgaatgtgtcttcttcagatactaaagtacagttggatcattttcttatctccttttcttaagcagtactttgcaggtactcccctttgaaagccagaagcataaaccattggggaatcttaacttgtagacatgcagtaaaagaaatgcatttatgtaagatctgtgagtacttaaaaagaaagccctcagtgtgtgtgaagtgaatgtgaaatgtgtgtgaaatacatagaattcccaaatagtttagcaaaggcagggcgcaatatcaagtaatttaaaaatggtccaaggaactgtaagaaggaggaactaattctagaataaatgttaaaatgccattcaagaacaaaaccacagatgccatacagacctcctgtgcttaagttatagaagaataaaaatctgaatgaatggaaggccttacgtgtatacagtttacaaattcctatttctaaaatttaagtcccttatttaacagaagtatgtattttaatgcttaactgtctcgggaaacctcatttgtgacatcatctaaggggatgggaagactagggagccagtgccacgttgaacagaacagtggtttagtgaatgtgtgaggaaagacatgggcaactgattattaatgtttttgtaattcagtttataacttggaaccaatgaaaagcaacaaaactaaactggtttgacagcctgccacttctggcatttcctgtaagtcactagcagtaggtgtgaggtgggcttgcccatgaccaggaggggtgtgtgtgtgtgtgtgcatgtgtgtatatgcgtgttggtctgcagtcacagcatacctttatgtgcatgtgtcctcgcagcttgggactcagcagtattctgggagggtggaggtgaactgtcccatgtattgtattatatattttttgagatggggtcttgctctgttgcccaggctggagtgcagtggtgcgatctcagctcactgcaacttttgcctcctggttcaagcagttctcctgcctcagcctgccaaatagctgggattacaggtgtgtaccaccactcccagctaatttttgtatttttagtagagatggggttttaccatgttggccaggctggtctcgagctcctggcctcaggtgatccacctgctttggcctcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtacaaggaagggacacagggcttaaaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaactcagaagcctggctctgttgctgtggtcaaatgcttgcctttgaggactttggcagattgtgctattacattgggctctaactttctggcacccgcaaggcagacctatgatgtccacatggctgactcttgacccctggccattgtgagcagaggaatcaagggtttagggaggcagtattgggcagtgtggaagagttagatgagatgaagcagttagcacagtgcttaacccatactaagtgcccccaaccctgccagccaaattaggtgcatagttttcagcttgggtctggattcaacagcattcccgctgcccactaaaagggtgggcttggacagttcctgaacctccctaaatctgtttcttcatctttaccacacacagtctgtctcagtggtggtgtggattaagtgaggtgctagcacttattaggggaagatcctccagacctgcaaagcagggctgcagccccaattctgacccagccctgctgtgtgtttgccgcaaagaggtttggtgtgtgcgagacatttctttatgaaccatttacactgctggaaatgtacccactaatgtgatggcaagaacttcaacaaattgcttatgaatcaggctctcaatggaagaagttaatcctctgaagagggggaagactggactttcagaagtatgttggggatagagaatgaagtttgagtcagcagagctctgccttcctgtttgtcaaagaactagagtctgggagtcttgcaagatggagctgggcttctgaagaacccagtgggtaggtactgggcatccattagacggcagtgctaagtcggtcatgtgcagcagaaagacctccccactgtgaacaacaaaccactttcctcctccagtggcccattcatttggattgatacactttttcagtgtcagaaatgcactttctccctctacttgtctgaattacgatgctctgctcaactctgtggacagtgtttcttgaatttccttttccaccgccttttcccactcaagaaagtggagagaaaaacagggatgcaggctgtgggtcttgtggaagccctttacaaccattaaataaagaacaccagctgc

SEQ ID NO: 3254 - DNA, 2281 bp, Homo sapiens
acaactggcctgaccttcaaaggccttcacagctcctgccttcatgttaccgtctactatgttcctcgtgcaccttccactcagcacaaacaggctgcactgcctccgaaacacatcacttgaatcctacctctgctcctttgtccatctgaatcaccctctccacatttctgaccgtgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgacgatgccgatgaattgccaggttgggaactgctgcccccagagaacctagcagagagctctgtacgtggtaggtgctcactcccctattgtttgggtgtatgcctcctgataatgaacttgatcgtaactttattgttgtattatgcctgtattgtttccttaagtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcacgggaaaaaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctcttctgtatggatctctcatcatagaggtgtgtgcatttctgactttgtgatttcaatactaaggaagctgtcggcagattatcaaggaaaacggggatcgctgctccccaacgtacacattctggtgtgccccagtaaaattctatattcagcctccaaactagctgggaaaaatgtggcaaatcatctacttgctccaattcaatggtgtttagaagtaggaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacgaggtctcactgtcacccaggccggagtgcagtggcacaatcaaggctcactgcaacctcaaccttctgggttcaagcgatcctcccacttcagcctttcaagtagctgggatgactacaggcatgggccaccacagccagctgattttttttttctttttagtagaaatgaggtctcgccatattgctcagactggtcttgaaccaacacatctttagctttttaaaagacagccttggccagccatggcagctcacacttgtaatcactgcactttcggaagctgaggtgggcagatagcttgagccgaggagttcaagaccagcctgggcaacatggtgaaaccccatctctacaaaaaatacaaaaattagctgggtgtgatggtgcacatctgtggtcccagctactggggaggctgaggtgggaggattgcttgagcctgggaggtcgaggctgcagtgagctgtgattacctcactgcattccagcctgggcaacagagaaccctgtctctattt

SEQ ID NO: 3255 - DNA, 1623 bp, Homo sapiens
ggccttcacagctcctgccttcatgttaccgtctactatgttcctcgtgcaccttccactcagcacaaacaggctgcactgcctccgaaacacatcactggaaccctgcctctgctcctttgtccatctgaatcaccctctccacatttctgaccctgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgatgatgccgatgaattgccaggttgggaactgctgcccccagagaacctagcagagagctctgtacgtggtaggtgctcactcccctattgtttgggtgtatgcctcctgataatgaacttgatcgtaacattattgttgcattatgcctgtattgtttccttaggtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcatgggaaacaaacaaacaaaaaaaaaggtttggtgaacaatggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctctcctgtatggatctctcatcatagaggtgtgtgcatttctgactttgtgatttcaatactaaggaagctgtcggcacattatcaaggaaaacggggatcgctgctccccaacgtacacattctggtgtgccccagtaaaattctatattcagcctccaaactagctgggaaaaatgtggcaaatcatctacttgctccaattcaatagtgtttagaagtaagaagtcactgtgagcaatgccaccaagtggtggagagactccatgcagaatcgccacctt

SEQ ID NO: 3256 - DNA, 3785 bp, Homo sapiens
acagaaggaagagcgcgaaattgcccaggatggacactttcaaaggggccccagcggctaagtgactctcagggaaggtggccttgccatcccaacttctatttaggggcaaccactagcaagttcttctcttcgggcaattggaaagagttcctataagcaaagtggaggtgatgtggacccctggaaaatttccttgccccgtttgaactttgcaatgattcactgcaagtcatgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatg

SEQ ID NO: 3257 - DNA, 1284 bp, Homo sapiens
attgtttgctctggcttctgtgccggatgaggtcattcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttctt

SEQ ID NO: 3258 - DNA, 587 bp, Homo sapiens
gtaacatcctggggagctctgaagctgagatttcataaagatcagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatat

SEQ ID NO: 3259 - DNA, 692 bp, Homo sapiens
gtttctctttgaacttgaactgtggctcttttgatatccagaaagagagttctttgtggggatggttaattcttgttttgggtgcttttcttcaccgctctaaggaactaccacagtcagaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgc

SEQ ID NO: 3260 - DNA, 1052 bp, Homo sapiens
agaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaa

SEQ ID NO: 3261 - DNA, 2374 bp, Homo sapiens
gcggggccgcggggagcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaa

SEQ ID NO: 3262 - DNA, 3316 bp, Homo sapiens
ggcccccgggggcttctgggagtgcctgccttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgcaa

SEQ ID NO: 3263 - DNA, 458 bp, Homo sapiens
aatgtgtgttagctgtggacttagaaaaaggaggccaccagaacaagctggaatcttggacagggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagtt

SEQ ID NO: 3264 - DNA, 834 bp, Homo sapiens
attcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagccc

SEQ ID NO: 3265 - DNA, 625 bp, Homo sapiens
acccagggctggagagtctgcgtgcatatttgcttacaagtagaggagctgatttttgtacagacaagtacatttcaccagtgctgccagcacgttctcttggtctggaaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtc

SEQ ID NO: 3266 - DNA, 2633 bp, Homo sapiens
gcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaa

SEQ ID NO: 3267 - DNA, 475 bp, Homo sapiens
gtgcttttcttcaccgctctaaggaactaccacagtcagaaggagaatgcagttgaaactaattttgtggatagagaaactgttggaactgctttacaaagtattttactctttcaagatcaaatgaagacagaattgttcaaagcgtgggttgacctcccctactcagtttttggctccttttggaaatctgatgtctgcccttctaagcgtaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagca

SEQ ID NO: 3268 - DNA, 583 bp, Homo sapiens
attgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgca

SEQ ID NO: 3269 - DNA, 790 bp, Homo sapiens
atatcgagtattgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagt

SEQ ID NO: 3270 - DNA, 570 bp, Homo sapiens
atatttgcttacaagtagaggagctgatttttgtacagacaagtacatttcaccagtgctgccagcacgttctcttggtctggaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcacc

SEQ ID NO: 3271 - DNA, 549 bp, Homo sapiens
aactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctatt

SEQ ID NO: 3272 - DNA, 552 bp, Homo sapiens
gcttttcttcaccgctctaaggaactaccacagtcagaaggtgcattcttactgcgatctttttatttgctaccttgggcttaaggagcctgcctatatctactgagccagagaatcctggtcaagccctgaacagtccagaaactctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcag

SEQ ID NO: 3273 - DNA, 559 bp, Homo sapiens
acttgtggctgagcagaggtgtatgtagtgcatttaggattttgccgaggagcacgtttttccatgggacagtgtgttgatatcaggctggctgtgatgggttccctgagtcaccctctgcgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgccc

SEQ ID NO: 3274 - DNA, 561 bp, Homo sapiens
ctgcaagtttagcactggcctgtcctgattagtgaggacctctgattgcctaggccagggctcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagt

SEQ ID NO: 3275 - DNA, 697 bp, Homo sapiens
attcgtgggggaggtgtgtttgtggagtaaggcagtgggagggtagaggaaaaggagataaagaaaaagcccatttctaactctctgaacaggcgaggccagcttatctgagatgcctgtgatcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtg

SEQ ID NO: 3276 - DNA, 2368 bp, Homo sapiens
ggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggtgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 3277 - DNA, 1976 bp, Homo sapiens
ggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggtgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaa

SEQ ID NO: 3278 - DNA, 1524 bp, Homo sapiens
gagtgaggtttggctgccaccaaagttacttctagtccttgctgtccactcctgccctcagtctggacctgcccaaggacccctgcaattaggcctcccatgcagaggtcagtgagagcccaagccaattgctctaggccccgtggctggctacttatggggcactgtcctgaccagctctgctaagatgctcctggcccctccctccaccccgtccagaggacggacccccagcgccgtggagaggctggaagccgacaaagccaagtatgtcaagacgcaccaggtgatagctaggcgacaggagccagccctgcgtgggagtcctgggccgctcacgccgcacccctgcaacgagctggggccccctgcatcgcccaggacgcccaggccggtccgccggggaagcggcaggcggctgccgaggcctgattccctcatcttctaccgccagaagcgggactgcaaggcttcggtgaacaaagagaacgccaagggccagggtctggtgcggcgcctctttctgggtgccccgcgggacgctgccccgagcagcccggcctccacagagcgacctgcggcttcagggggttgggctgcgccccaggatgccccggaagcggcgggaaagcgggcgctgtgtcccacgtgctcgctgcccctgtcggagaaggagcgcttcttcaactactgcggcctggagcgcgcgctggtggaggtgctgggcgcagagcgcttctccccgcagagctggggagccgacgccagcccgcaggccggaacttcgccgccgcccggctccggggacgccagcgactggacatccagcgacaggggcgtggacagcccgggcggcgcgggcggcggcggcggctcggaggcagcgggctcggcgcgggaccggcgccccccggtgtcggtggtggagcgcaacgcgcgcgtcatccagtggctgtacggctgccagcgcgcccgcggaccgccgcgcgagtccgaggtgtgaccgccgcggctccggactggccccgggactggccccgggcacggaaaaggacacccctcttctggcgcgctgggtgcctttgcgtaagcccttccttctggaactcagtttcgcgtctgaaccttggggaggtggaacaagttgctgccgaaggcccttccctgctcccgcggcgaagggggagggagaggcctcttggtccctgtggagacccggtctggggagtcacgattggggtgggagatgagcaaacctgctgaataaagttaaaacgttatttaaatggggagctgaggaaggagcaaacgggttttcgcggttaaacccgtgggttttggaatgtgtgttcccggctgtgtgatcctgggcaagaacttgacctccctggacgcagcggcacccctcggttattaaggagggaggagtaggggatagaagtatttcaaaatagttgtaatgcgcatggcaaagtgcccagcatatagaaagtgctcaataaacgataactgctgtgacttcta

SEQ ID NO: 3279 - DNA, 3592 bp, Homo sapiens
ctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 3280 - DNA, 3780 bp, Homo sapiens
ctccagcccggcccaggccagcctaccggcgactaggatgctttcgctttcgctctcgctttccaatactcgggactggggaaaccgggagaatagaagcaggcaaggaccgccgtgggcacggggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctg

SEQ ID NO: 3281 - DNA, 867 bp, Homo sapiens
ctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtggtaccatctccagggagagcaaggttggagcctaaggggaaagatgggacgcaggacaccagctaatcttttcctctgtacaattaatgacagctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaat

SEQ ID NO: 3282 - DNA, 6189 bp, Homo sapiens
ctccgcttcctgcgcgcgcgagactcaagctgccacagtggctctgccgccagcgtcccagctcctcccacacccgagtttttatttcctgctccctctccagcccggcccaggccagcctaccggcgactaggatgctttcgctttcgctctcgctttccaatactcgggactggggaaaccgggagaatagaagcaggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctccagcaagacctaatcaacctcccaaccctcaactcagaatcagtgtgtgccctgaagtcccttcaaccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagatttttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagtgagtgagcacacagggcgctggggtgctccgcggggcgcggtcacgggcgcggccgcggcgggctcgagtcccggctgggaggagaaggagctgggtgtcaggaagccggggactgacagcgccacccatctggggagccgggaggacacaggttttattttggtagtgctgcaagtccccttgtgtgctggggggagcggggcggcgtggtaggattggaagaggcttagagttggcctcgacccctgcccttgcccctggaaaggcagaaagtgggggttggggtgcggagaagcaggaagagagggagagtgaaggaggggaggaaagggagagaggaagagggagagtgaaggaggggaggaaagggagagaggcagagagggggaaggagagagggaaggaaggagagattgagagacagagaaattcctaaggggagctgtcaggtgggctggacatgggccccaggctgcactgctttatccctttgctgtaggaagtcaagcaagttctttaggtaagtagaaccttgatgtcaagtataaaacaggggttggtataggatagctaagagcactttatattttgatataatctgatttatcctggatactgaaaacaatgtagggagacggaggatattggagtgttttcttaacctcttgcccctttccactgtgattgctcaagtacatgcaaaattaatgtttctttctgcccattttattttcctttttttgtctgtgtctattaatcattcctaaagcacccggatcctctctcaaacttcgtaagatgagacatcatgaacagacacagtgaatccctagattttcttaatagttgggcaacaagttcttgcatttagggatgttgcaacatagcccagttccgcaattgtacattttctattttttttcctaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 3283 - DNA, 3996 bp, Homo sapiens
gactatcatccctagcaaactttccagatttctttttaaaatctcattccaagtttctttcctcagctctatcctcaccacttccctgtaattttatctccccttgccatcttcatcttaaatgaataacagattttaacatcaatgtaactagaacagctttttgaaatttccaactgaaaattattctattatttatacttgcatttgaattccatctctgccacatagctctggccttgggcagttcgtctaccttctctaagctatactttccccatcagcaaagtgtagctatacctaatttgcatagcatccgcaggaatttgcagctagagataattttcataaagtgtttagtataattttcatgaagtgcctgacacgcagtgttctcgaaaagagagcttttattgttaaggtgattatagttggtgaataaactatctatttgctaaggtaccatctccagggagagcaaggttggagcctaaggggaaagatgggacgcaggacaccagctaatcttttcctctgtacaattaatgacagctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 3284 - DNA, 423 bp, Homo sapiens
tcccgcccagctggagctctggagcctttgcttcctcaaatacgagcgggaactgcgttgagcgctggattccaggccgagtgctggcgaggcgcgcatgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctc

SEQ ID NO: 3285 - DNA, 4202 bp, Homo sapiens
tagtgctgcaagtccccttgtgtgctggggggagcggggcggcgtggtaggattggaagaggcttagagttggcctcgacccctgcccttgcccctggaaaggcagaaagtgggggttggggtgcggagaagcaggaagagagggagagtgaaggaggggaggaaagggagagaggaagagggagagtgaaggaggggaggaaagggagagaggcagagagggggaaggagagagggaaggaaggagagattgagagacagagaaattcctaaggggagctgtcaggtgggctggacatgggccccaggctgcactgctttatccctttgctgtaggaagtcaagcaagttctttaggtaagtagaaccttgatgtcaagtataaaacaggggttggtataggatagctaagagcactttatattttgatataatctgatttatcctggatactgaaaacaatgtagggagacggaggatattggagtgttttcttaacctcttgcccctttccactgtgattgctcaagtacatgcaaaattaatgtttctttctgcccattttattttcctttttttgtctgtgtctattaatcattcctaaagcacccggatcctctctcaaacttcgtaagatgagacatcatgaacagacacagtgaatccctagattttcttaatagttgggcaacaagttcttgcatttagggatgttgcaacatagcccagttccgcaattgtacattttctattttttttcctaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 3286 - DNA, 3488 bp, Homo sapiens
aaatccagagcggcgggcactgacgggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatcatgaattccatgaagactgaagaaaacaagtcatttagcgctatggaagatgaccagaggactagacctgaagtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagttta

SEQ ID NO: 3287 - DNA, 3344 bp, Homo sapiens
gcgggaaaagttcagctgagagatataaaagagcagtctttccagcacctgcaaatccagagcggcgggcactgacgggcacttgcaccgtgtggacagactctccggttctgatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaacctaaataaaagtttaaaatatatataatgcc

SEQ ID NO: 3288 - DNA, 2364 bp, Homo sapiens
caaatccagagcggcgggcactgacgggcacttgcaccgtgtggacagactctccggttctggggaaatccagtccctgttactccattttggccagaaattcaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaagaaaaaagtccacaaaccaaagaaagatggagagaccaaagatgtagaacacagcagagagcaaattctcccacctcaggatctaagccattatattaaagataaaactcgccagacaattcccaggattagaaattattacttttgtagtttgccccgaaaatataggcaaataaactcacaagttagacggaggccgcatctgggtaggcggtatgctattaatctggatgtccaaaaggaggcaattaatctcttaaagaattatcaaacgttgaatgaagccataatgcatcagtatccgaattttaaagaggaggcacagtgggtaagaaaatattttcgggaagaacaaaagagaatgaatctttcaccagctaagcaattcaacatatataaaaaggacttcggaaaaatgactgcaaattctgtttcagttgcaacctgcgaacagcttacatattatagcaagtcagttgggttcatgcaatgggacaataatggaaacacaggtaatgctacttgctttgtcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaag

SEQ ID NO: 3289 - DNA, 557 bp, Homo sapiens
aaatccagagcggcgggcactgacgggcacttgcaccgtgtggacagactctccggttctgatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaag

SEQ ID NO: 3290 - DNA, 1706 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 3291 - DNA, 2016 bp, Homo sapiens
gtccgggtcacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 3292 - DNA, 962 bp, Homo sapiens
gtcacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggagccagcccttcccaccccatgaattcttcaactataatccagtggaggacttctcgatgccaccccacttag

SEQ ID NO: 3293 - DNA, 1187 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctg

SEQ ID NO: 3294 - DNA, 1170 bp, Homo sapiens
cgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctg

SEQ ID NO: 3295 - DNA, 840 bp, Homo sapiens
atgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctag

SEQ ID NO: 3296 - DNA, 2071 bp, Homo sapiens
attgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcac

SEQ ID NO: 3297 - DNA, 2328 bp, Homo sapiens
gccggctctcaactttgaggagtttcaagcagccgcggcggcagcagcagccctggacgcagcagccaagctcttcgctggctcccgggggctctcccgggttcctctcattgcaggctgaaggtaatgagaggccctaagatcccagaggatgccataagaggaaaagtcaggggagtgttgaagactctgcctcctacaaatatccgtgaacataccacaccagcaagaacaataagagccaagggtctgaattgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaa

SEQ ID NO: 3298 - DNA, 796 bp, Homo sapiens
caatgatctacaggagaggaagaaagctatctagggacgagatctagaatcaactgagagagatgcttaaaaatcaccagttactttaatgacaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctg

SEQ ID NO: 3299 - DNA, 732 bp, Homo sapiens
caaagatgtttcctttctttttcaaagcaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgt

SEQ ID NO: 3300 - DNA, 476 bp, Homo sapiens
tttaatgctaaaaagaaggatccaggccaaggagggtaaagaaaatgcagaatgcaaattatcccctcactgggggatatccgggagcgaagtccctgagctgctgaggaagctttacgcctaaggagaagaggaaactggttcagaactgtgggcagccagcccaagagcacgcagctgtccaggggcagagtccacgtctggcttctttgtctggagttgaaagccagatcaccaccttctgccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaag

SEQ ID NO: 3301 - DNA, 4443 bp, Homo sapiens
ttccggggcagtaggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattctccaactttgtggttttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataacatagattagtataaagactgtttctacgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttctgaagtttcagaaaaacagttgccttctggttacaaaggctggtgtcaccagttctgaattgttgcctcaagcttggttgatgtgtctgaacctgtatcccttgagggcaaagtttagaaactggtcactctgcctactgtctgttcagcctcttgtacaatggcagtttggcagctttaaatccttaacctagaaatgtatttaaggtttttctttcaagaaatggggtatacatatgaaggagagagtaacaactctttttatacacctattcagatttcagccctgaatttggcaaattttagattaggtctcacataaggtaaatatgactcactaactctttttttctcatcttccccacccccccatatatatttatttattttaatggagttagggaccactagtgaaatgatgaaaggcccaattctgagtaacaattgtctactcttcacataaaatatactgaaaaagaattaagattccttgatccagtagacatagagaaacataaacattcatgacagatgagtaggtaaattcagggatcactttggaacttgctggattatggtgatggtttttggatagtatgtgcttcattattttatttggggtagttacagtgttttagttttttgttaacagctacacttttggtactattttccttttaaatttttggtgtctaagatttaccactaattactaatatatgcctttccaattcacttaaaaccttaataagtgaaatgttcaggtattgctagggtaaatgtgtcttttcctactattgagattttaaaaggctgtgattaagagagactttattaatttgatctgaaagaagtagaaacctctatgaaacaatttttattttcctttgcataataccttagaaatgtgttaaggacaagctatattttccttacttgcttttgatagtttttttttttttttttaagcatagatatccaggttggcaggcctctgaaatgtgaaattgtaatttttatagatggcattactatgaatctgaaatcagtgctaggtgtacaaatgtgaatttttcaatcctgtaatcaaagaacaagatcttgtgggttcctactgctgaaaaaggatgctttcttttgtacttgtttttagtgaaagacctttttgagggagagctattttataggtagttgctattgatatctccatttgagaaatagacatttttctgtatttctagaggtgttctgaattttaaacctgaattcttcagtttagaaaacccagaataaaattatacccacagtgggcactcaacaagtgtgatatttcacaaa

SEQ ID NO: 3302 - DNA, 2044 bp, Homo sapiens
cgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggccttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggcttt

SEQ ID NO: 3303 - DNA, 794 bp, Homo sapiens
atattatatgcccatatattctgaactccatagtgttgtcttaatctacctttctagcttcatgccttcccattgttcttctctctgccatggtaactactccctactgtaactgtccatgttccatactgtcagacctcaggcctttggctgtaccctcatgttatttccatatccttgaatcctgtcattggcatcatcatctgtcaaaatcataagcttcttttaaggcaggtgttgccaactcagatgcctacagaggttaatcaggtagcataatttgagtgaagtggatttgcgtgggggattgtagggagctggagagcaactgccctagctaaaagggcccagcggctatttagcacaagctagttattacagagttgaatgtgggcccggtgttgctagatcttttaattttacaagttagaagttggaagcctatatttttatatgaagtctgatttttaaatgttggcatctagtttttgcaaaggttaaatactgtgcaggccaaataaaaacatctgtaggctggatttggcacttaaattcccagtttgtgaccactactctaggcttatttcagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttc

SEQ ID NO: 3304 - DNA, 550 bp, Homo sapiens
agtaggaacgccgagtcggctgccgtggctgtgctgagggtggcggccggataggtgcggagcttcctgaacgaggcaggagggggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtag

SEQ ID NO: 3305 - DNA, 609 bp, Homo sapiens
gctgaaggagcacttccggggcagtaggaacgccgagtcggctgccgtggctgtgctgagggtggcggccggatagggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaat

SEQ ID NO: 3306 - DNA, 2121 bp, Homo sapiens
acttccggggcagtaggaacgccgagtcggctgccgtggctgtgctgagggtggcggccggatagggacccagaactccatttgacagatgaggaaacggagaggcagacagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaa

SEQ ID NO: 3307 - DNA, 754 bp, Homo sapiens
ctgcgctgaaggagcacttccggggcagtaggaacgccgagtcggctgccgtggctgtgctgagggtggcggccggataggtgcggagcttcctgaacgaggcaggagggctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcag

SEQ ID NO: 3308 - DNA, 562 bp, Homo sapiens
gtgctgagggtggcggccggatagggacccagaactccatttgacagatgaggaaacggagaggcagacaggtgacctgacttccccacaatcgctgcaggacaggaagaaagtaaactccagagcccgtgctcttagctactaagctgtactgctcttcattttgagacaccaatagtatcttggctttaattgccaaagagctctacatctggaaggaattgaattgagtaacactggtattcaaaagttgatctgacataaagccaatctgatggcttaaatttcatgatgtcctggaaaaattgagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccaga

SEQ ID NO: 3309 - DNA, 3379 bp, Homo sapiens
ggccggataggtgcggagcttcctgaacgaggcaggaggggtgcgaggttcaggggcagggcccgggcagccgaagtcgttagggaggcggtgacctgacggtgggcggcggacatctcgcggcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagtgagagcgcatgtttgctcatctagagacagccgtattaataacgataggatacaaaccatcaccccaccaagtgatagcagctgttaacctgtgggcggttacgtgccggtcactgttccaagcccctcacatatcgcgtcactgaatctttatagggacccagaactccatttgacagatgaggaaacggagaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattctccaactttgtggttttttaatgattaaggtaatttgttagctctgcccctcatcttctaaaacctttgtaataaaatgtattaatcatgttatttgatcctttcatttacttttgtaaacacgagccctaatatcttacttagaccaaaaaaaa

SEQ ID NO: 3310 - DNA, 576 bp, Homo sapiens
gagtcggctgccgtggctgtgctgagggtggcggccggataggtgcggagcttcctgaacgagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaa

SEQ ID NO: 3311 - DNA, 571 bp, Homo sapiens
gagtcggctgccgtggctgtgctgagggtggcggccggataggtgcggagcttcctgaacgaggcaggaggggtgcgaggttcaggggcagggcccgggcagccgaagtcgttagggaggcggtgacctgacggtgggcggcggacatctcgcggcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagtgagagcgcatgtttgctcatctagagacagccgtattaataacgataggatacaaaccatcaccccaccaagtgatagcagctgttaacctgtgggcggttacgtgccggtcactgttccaagcccctcacatatcgcgtcactgaatctttatagggacccagaactccatttgacagatgaggaaacggagaggcagacagctgatgttctaatcatgtcagataaagatgatattgagactccactgctaactgaagcag

SEQ ID NO: 3312 - DNA, 3343 bp, Homo sapiens
ctgggcggagaagctgcttcctcctgggaacaaccgcctcccgctcctagcaggttgctactgccccgaacccgcgctgcagggaacagcggggcaaacaaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaaggttgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgtaaggagtgcccatcgaggtggcaggccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctaccc

SEQ ID NO: 3313 - DNA, 840 bp, Homo sapiens
ctcctccagctccagcctcctccccgctcccaaatcccggctcggtcgcccagtcactggtacagggaagcctcttccctgtgcattcctctctgcgccaggctctgcccgctcccacctgcccccgtggaaatcgcagggtgacctgactggctttgggcctgggaggaaagaagagagtggagccccgccagactccaagctgagtgctgacagcctctgggagtttagaacatcccttctcacacactgtgcatttgatagaatactccctgaggcacgcagatcaacagctggggggtaggcagcgcccacatttaaaaagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctg

SEQ ID NO: 3314 - DNA, 576 bp, Homo sapiens
accccccacccccgcagtctccgcctaagactttccaagtcctgtagtttcgagcccgctgccctttgcctcctgggcggagaagctgcttcctcctgggaacaaccgcctcccgctcctagcagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtgg

SEQ ID NO: 3315 - DNA, 5733 bp, Homo sapiens
gtagtttcgagcccgctgccctttgcctcctgggcggagaagctgcttcctcctgggaacaaccgcctcccgctcctagcaggttgctactgccccgaacccgcgctgcagggaacagcggggcaaacagtgagtggggttcagcgtagactctggaccaggagaggcccgcggtgaccgaggcctgggccccggaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaaggttgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgatttttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatctt

SEQ ID NO: 3316 - DNA, 577 bp, Homo sapiens
aaccgtctgcactgcagcccacctccccccacacgcctcctcctagccacttcactaccaatttgcaaattcccaaggcgtctgccccagcgccttcccacatctctgtggaagactccccactccaaagtagcctggtgtggaaattgctggacgaaaggactggctttgggcctgggaggaaagaagagagtggagccccgccagactccaagctgagtgctgacagcctctgggagtttagaacatcccttctcacacactgtgcatttgatagaatactccctgaggcacgcagatcaacagctggggggtaggcagcgcccacatttaaaaagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccc

SEQ ID NO: 3317 - DNA, 634 bp, Homo sapiens
gactcccgtggaaacccctcctctcctccagctccagcctcctccccgctcccaaatcccggctcggtcgcccagtcactggtacagggaagcctcttccctgtgcattcctctctgcgccaggctctgcccgctcccacctgcccccgtggaaatcgcagggtgacctgaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcata

SEQ ID NO: 3318 - DNA, 2958 bp, Homo sapiens
tccggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgtt

SEQ ID NO: 3319 - DNA, 4885 bp, Homo sapiens
ttttcttttaagaaatgcctttttatgaaaatatttcaaaaggaattcaagtttattttgaaaaaatgcacaccaatacagaaatatagagaggaaaatggcaactcatcctcctcaccacaccaccagctccagtctcatgcctctggaccaaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccagagtctcactctgtcatccaggttggaatgcagtggcgcgatctcagctcatgcaacctccacctcctgggtttaagcaattcttctctctcagcctcctgtgttgctgggactacaggcacacgccaccatgcctggctaatttttgtatttttagtagagagggagtttcaccgtaaaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttttcctcacaaagctgttgtttgatttctcctggtcccatagtggactgttaacggtgtccagtctagcgtgcacatcctgggtgctgaatctcacttcagtgttgacccccttggggttagcattcagtccttgtatatttagagaatgtcaatgttttcccagacatggtatcaataatggtagttgtcagcagtatcttagccctttctacattttttctcccacttctggaaggattcttgggtataacctaacccaaagaaaagtggcatgtgctgaaactgagtgtcacagagctgtgaggttgggtctttgggattagcttcattttccagggtttgccctttgcccttcaaccaaaggacaaagtcatgttaacagctgctactaagtctatatgcccattcgttcataccacaaaacaggcatctgactcctctggtcaccatggaatcaaggcactgtcaagtggtggggggtccacaggcacagtgggcttcactctggaacaggattactgggtgcagcggatgtaatcctcacttaatcaacccacaccccagcatcccctgagctttctcttaatctcattctagcccatcttgactcttcggttagagggagttctcattggagatttgtctctgggattaatgagtgtatgcctagctactttctccagtttacttttagaccatattgttgtttgttttgaatatcattccttaggctatgttgagagtagagtggcttcccattaggagaactaatttagggcatgtcttttgctgaatcccgtcagcatatttaacaaattcccaattctagataatttccttttatttctctagtaccctttgccaggggctctacacatcaaaggtgttcatgaagtatttgtcaaaggaaagaacagtaatgacacctaacacataatgagtgattagtatgttccaggcattgcgtgagctatttactgtgagtgatttaatgttatcttcccagcagacctctgaggtaggtactagtatgatccccatttcgtacatgaggaaactgacactaagggacataaaataagttttttgaagtcacaaagtgaataaaaggaagaaccagggtttaattgaagcccatagcaatgaaaacattgtggaacttattcttcatgaatggtttacaatttaaacaaaatgtcacctagaaaatagatgaaaatatgttcaaccaggtctggatttttccaatgtttactactgaattttcattcaataacaagtttaacttccaaaaaggtgttggtatctgattttctgcctgcctcagaatgtgatttgtctgcctttgggtcatccagccttgggtagagaaggaatttgaactcaggaaattcaactccagaactgatgttcttttttttttttcatttaagttctgggatacatgtgcagaacgtgcaggtttgttacataggtatacatgtgccatggtggtttgctgcacctatcaatccatcatctagattttaagctctgcatgcattagatatttgtcctaatgctctccctcccattgcccccaacctcccgacaggccccagtgtgatgtttccctccctgtgtccatttgttctcatttttcatctcccacttatgagtgagaacatgtgttgtttggttttctgttcctgtgttagtttgctgagaattatggcttccagcttcatccatgtccctgcaaaggacatgaactcattctttttcatggctgcatggtattcaatggtatatatgccatattttctttatccagtctatcattggtgggcatttgggttggttccaagtctttgctattgtaaataatgctgcaataaaagtatgtgtgcatgtg

SEQ ID NO: 3320 - DNA, 2332 bp, Homo sapiens
gacccgtcccccgcgcgccactgcagagcctgtccgtcagtccctaggtatccgcactgctcaggggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgtt

SEQ ID NO: 3321 - DNA, 2070 bp, Homo sapiens
ttttcttttaagaaatgcctttttatgaaaatatttcaaaaggaattcaagtttattttgaaaaaatgcacaccaatacagaaatatagagaggaaaatggcaactcatcctcctcaccacaccaccagctccagtctcatgcctctggaccaaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatga

SEQ ID NO: 3322 - DNA, 5568 bp, Homo sapiens
ggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttttcctcacaaagctgttgtttgatttctcctggtcccatagtggactgttaacggtgtccagtctagcgtgcacatcctgggtgctgaatctcacttcagtgttgacccccttggggttagcattcagtccttgtatatttagagaatgtcaatgttttcccagacatggtatcaataatggtagttgtcagcagtatcttagccctttctacattttttctcccacttctggaaggattcttgggtataacctaacccaaagaaaagtggcatgtgctgaaactgagtgtcacagagctgtgaggttgggtctttgggattagcttcattttccagggtttgccctttgcccttcaaccaaaggacaaagtcatgttaacagctgctactaagtctatatgcccattcgttcataccacaaaacaggcatctgactcctctggtcaccatggaatcaaggcactgtcaagtggtggggggtccacaggcacagtgggcttcactctggaacaggattactgggtgcagcggatgtaatcctcacttaatcaacccacaccccagcatcccctgagctttctcttaatctcattctagcccatcttgactcttcggttagagggagttctcattggagatttgtctctgggattaatgagtgtatgcctagctactttctccagtttacttttagaccatattgttgtttgttttgaatatcattccttaggctatgttgagagtagagtggcttcccattaggagaactaatttagggcatgtcttttgctgaatcccgtcagcatatttaacaaattcccaattctagataatttccttttatttctctagtaccctttgccaggggctctacacatcaaaggtgttcatgaagtatttgtcaaaggaaagaacagtaatgacacctaacacataatgagtgattagtatgttccaggcattgcgtgagctatttactgtgagtgatttaatgttatcttcccagcagacctctgaggtaggtactagtatgatccccatttcgtacatgaggaaactgacactaagggacataaaataagttttttgaagtcacaaagtgaataaaaggaagaaccagggtttaattgaagcccatagcaatgaaaacattgtggaacttattcttcatgaatggtttacaatttaaacaaaatgtcacctagaaaatagatgaaaatatgttcaaccaggtctggatttttccaatgtttactactgaattttcattcaataacaagtttaacttccaaaaaggtgttggtatctgattttctgcctgcctcagaatgtgatttgtctgcctttgggtcatccagccttgggtagagaaggaatttgaactcaggaaattcaactccagaactgatgttcttttttttttttcatttaagttctgggatacatgtgcagaacgtgcaggtttgttacataggtatacatgtgccatggtggtttgctgcacctatcaatccatcatctagattttaagctctgcatgcattagatatttgtcctaatgctctccctcccattgcccccaacctcccgacaggccccagtgtgatgtttccctccctgtgtccatttgttctcatttttcatctcccacttatgagtgagaacatgtgttgtttggttttctgttcctgtgttagtttgctgagaattatggcttccagcttcatccatgtccctgcaaaggacatgaactcattctttttcatggctgcatggtattcaatggtatatatgccatattttctttatccagtctatcattggtgggcatttgggttggttccaagtctttgctattgtaaataatgctgcaataaaagtatgtgtgcatgtgtctttatagtagaatggtttatagtcctttgggtgtatatccagtaatgggattgctgggtcaaatggtatttctggttctagatctttgaggaatcatcacattgtcttccacaatggttgaactaatttacactcccaacaacagtgtaaaagcattcctgtttctccacagcctcaccaacatctgttgtttcctgactttttaatgatcgccattctaactggcatgagatggtaccccattgtggttttgatttacatttccctaatgaccagtaatgatgagctttttttcatgtttattggccacataaatgtcttcttttg

SEQ ID NO: 3323 - DNA, 2976 bp, Homo sapiens
cctccgacccgtcccccgcgcgccactgcagagcctgtccgtcagtccctaggtatccgcactgctcagggcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgttta

SEQ ID NO: 3324 - DNA, 4655 bp, Homo sapiens
ctgcgcggaggcaagcgcgctctgcggcgcggtccgctgtggaggcggcgcgaacggtcagggggcggccgatggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggtaatttatcctcagcattccaaacttactgacagagaaaaaaccaatatttgctatttgtcttttccagattcaaattcaggttgtcttggagatacccagttttgttttagatttcgacagtcttctgggaggagggtgtcgctgcattgtctcctggatcaatttgacaaagatttaccagtttacttaaagaaggatcctgcttatttttatggatatgtgtatttccgacaagttcgagataaaactctaaaaagaggctactttcagaagtccttggttttgatcagcaaactaccttatattcatttttttcacactgtgctcaaacagatagcaccagagtattttgaaaagaatgaaccttatttggaagcagcttgtaatgatgttgatcgatggcctgccccagtgccagggaaaacattacacctgccaatcatgggggtggtaatgaaggtacggattcccacatgtcatgacaagcctgggacaactcaaatagtgcagttaactcagcaggtggacacaaatatatctgttattttacctactgttcatgaggtggatattttcaggtgtttctgcccagttttccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacccaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggacttacttctctggatccagaaacacacagaagtagaaacagtagaccttgtcttgaagctgaaaaataagctgttgcaggctgatcgagagcacttacctgtgaaacctgacactatggaaaagttacggacacacatagatgccattatcttagcattgccagaggacttgcaaggcatactgctcaaaacgggcatgacatgatatttgccaagattttccagccaaaaaggattatgcatcatgaagcatactgacatttcaaccagacgcacaaaggagatctctcagtggcagcggagtggaaaattgccatgaatgctagttacagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggtttttttcagttgtcatatagattttcattattttcccttccattttcaaaatttaatgttaccagtttctccaaagacaagaaggcatctagtattaatgatggaagagtttattttctcttaccctttactaatttaaacattaggctgggtgtggtggctcacgcctgtaatcctagcactttgggaggccaaggtggacaggtcacttaaggtcgagagtccaagaccagcctggccaacatggtgaaaccccgtctctagtaaaaatacaaaaattagccaggcatggtggcacgcgcctgtaatcccagctacttgggaggctgagatgtgagaatcacttgaacctgggaggcggaggttgcagtgagctgagattacacccctggactccagcttgggtgacacagtgagactgtgtctcaacaaaaataaaaaattaaataaatactaatttaaatattattaaatgtttaaactaatgaacttggctgcttttcaaagacattttaattataaatctcataatcagctatttttttaaactgaactattcttatttcaaaggcattcatgagttttttatgtgatacttatttgagtgatgataagattgatttctggcattatttgtttggtagcgttttatttttcccaacattaatgtttcttaaaacacttttcctactattgtttgacatgggaactttcgcctgagtcactgtcatggttagcttttgttgttgttgtttttgtttctgttttgtttaaacaatactaccttgccaaaaatagaagaatgtgatttggtagagtagggttgtttggtttgtgtttgaataagagtatcctacagaagccactttttttttttttgagatggagttttgctcttgttgcccaggctggagtgcaatggcgcaatctcggctgactgcaacctccacctcccgggtgcaagtgattgtcctgcctcagcctcctgagtagctgggattacaggtatgtgccaccacgcctggctaattttgtatttttagtagagatggggtttctccatgttggtcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaa

SEQ ID NO: 3325 - DNA, 2006 bp, Homo sapiens
gactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcacctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagccttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccaca

SEQ ID NO: 3326 - DNA, 2365 bp, Homo sapiens
cagcagataagcagcggcctcgggggttggggggctgtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 3327 - DNA, 5772 bp, Homo sapiens
gggggggaccatgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcggcggtggcccgcgcaccgcctcgcgcagcaccagccccacgcgcggcggcgggaacgcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcaggtgacaaaacacgacagccttcttcaagcccctccagtattatccgacgcacttcctccctggatactcttgctgcaccgtatcttgctggacactggcctcgggatagccatgggcaagctgcaccttgcatgagggacaaagctacacagacagagagtgcatgggctgaagaatactctgaaaagaagaaagggtctcacaagcgctcagcatcttggggcagtacagatcaacttaaggagattgcaaaattacgccagcagttgcagagaagtaaacacagcagtcggcatcatcgagataaagaaagacagtctccatttcatggcaaccatgcagctattaaccagtgtcaggctcctgttccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaagagaatgggaacaattctcctttgcccaaatatgcaacctcaccaaaacctaacaacagttatatgttcaaaagggaacctcctgagggctgtgaaagggtcaaagtctttgaggaatgctcgccaaaacagcttcatgaaatcccagccttttattgtcctgacaaaaacaaggtgaatttcattcctaaaagtggatctgctttctgcctcgtcagcatcctcaagccactccttcctaccccggatcttacactcaagggctctggccacagcctgacagtcaccactggcatgacaaccactctgctgcagcctattgctgtggcctccctgtctacaaacacagagcaagaccgagtctctcgaggaacaagtacagtcatgccatcagcttctctactcccaccaccagaaccaattgaggaagctgaaggataggtcacagtgcaacgtggctgttgttctgggaaattgggaacctcctcagatcactggattctgatggcatcgtgcgcttctggtcggctgtgatgtgctccagctttccagtgacatgtgacggcgaggcttctggaagaaaggatcccccgtgacggctctgccccacttgtgaacgccaaccctcagtgcttagcctgctttttatcaaagcactgattgaaacaagaaaggtctcattctttacctttggagagacaatatcacgtttttgttttcgaattagacttctttaaaacacacacacacacacacacacacacacacacacacacacacacacccctgatccttgccaacatgattcctaaagggagatgtgactgatgctgcaagaaccatcttttctatgaaaatgactattttataatataccaatgttacattttctgaaacgtagcaaacaggatattcaaaagattctttggtggcctctgtttcttgttccctttctagatgtgtgcttttctcagctgttttcagctttgggaccaaagggattgttgacgttttcccagcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtggtggttggccctgagatttgttgcctacagattttgctaatttacccccctaacgcttcacatagtggggaaaatacacaagaagaacttgagtatgaacgataagcacctttgaaaactccatacagttttggattagggctcatcctaatataaatcactgccagtatcacatgacatcagtatgtgatttctgggtatgtggtagtgagattaaggagcagcttttttttttttttttttttgagacggagtttcactcttgttgcccaggctggagtgcaatggcgcaatctcggctcactgcgacctctgtctcccaggttcaagcagttctcctgcctcagcctcccaagtagctgggattacaggcatgcaccaccacacccagctaattttgtatttttagtatatatggggtttcaccatgttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttg

SEQ ID NO: 3328 - DNA, 5763 bp, Homo sapiens
atgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcggcggtggcccgcgcaccgcctcgcgcagcaccagccccacgcgcggcggcgggaacgcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcaggtgacaaaacacgacagccttcttcaagcccctccagtattatccgacgcacttcctccctggatactcttgctgcaccgtatcttgctggacactggcctcgggatagccatgggcaagctgcaccttgcatgagggacaaagctacacagacagagagtgcatgggctgaagaatactctgaaaagaagaaagggtctcacaagcgctcagcatcttggggcagtacagatcaacttaaggagattgcaaaattacgccagcagttgcagagaagtaaacacagcagtcggcatcatcgagataaagaaagacagtctccatttcatggcaaccatgcagctattaaccagtgtcaggctcctgttccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaagagaatgggaacaattctcctttgcccaaatatgcaacctcaccaaaacctaacaacagttatatgttcaaaagggaacctcctgagggctgtgaaagggtcaaagtctttgaggaatgctcgccaaaacagcttcatgaaatcccagccttttattgtcctgacaaaaacaaggtgaatttcattcctaaaagtggatctgctttctgcctcgtcagcatcctcaagccactccttcctaccccggatcttacactcaagggctctggccacagcctgacagtcaccactggcatgacaaccactctgctgcagcctattgctgtggcctccctgtctacaaacacagagcaagaccgagtctctcgaggaacaagtacagtcatgccatcagcttctctactcccaccaccagaaccaattgaggaagctgaaggataggtcacagtgcaacgtggctgttgttctgggaaattgggaacctcctcagatcactggattctgatggcatcgtgcgcttctggtcggctgtgatgtgctccagctttccagtgacatgtgacggcgaggcttctggaagaaaggatcccccgtgacggctctgccccacttgtgaacgccaaccctcagtgcttagcctgctttttatcaaagcactgattgaaacaagaaaggtctcattctttacctttggagagacaatatcacgtttttgttttcgaattagacttctttaaaacacacacacacacacacacacacacacacacacacacacacacacccctgatccttgccaacatgattcctaaagggagatgtgactgatgctgcaagaaccatcttttctatgaaaatgactattttataatataccaatgttacattttctgaaacgtagcaaacaggatattcaaaagattctttggtggcctctgtttcttgttccctttctagatgtgtgcttttctcagctgttttcagctttgggaccaaagggattgttgacgttttcccagcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtggtggttggccctgagatttgttgcctacagattttgctaatttacccccctaacgcttcacatagtggggaaaatacacaagaagaacttgagtatgaacgataagcacctttgaaaactccatacagttttggattagggctcatcctaatataaatcactgccagtatcacatgacatcagtatgtgatttctgggtatgtggtagtgagattaaggagcagcttttttttttttttttttttgagacggagtttcactcttgttgcccaggctggagtgcaatggcgcaatctcggctcactgcgacctctgtctcccaggttcaagcagttctcctgcctcagcctcccaagtagctgggattacaggcatgcaccaccacacccagctaattttgtatttttagtatatatggggtttcaccatgttggtcaggctgttcttgaactcctggcctcaggtgatctgctcgtcttggcctcccaaagtgctgggattacaggtgtgagccaccacgcccatccaggagcagctctttttttaaaagtgagtttcagcaaacagtattgaataaaagcatccttttcatatcttcatatactactttatgatgcaataatttactgttcctatacatattataaggtagaaaaaagtttttaaatccttataaagaggatgcagtttagaaggttaatatgtcagcttacccagacatattctatcaaggaaaacctagtggtagcaataaatctttggaaaggacttcttatactcatgtacctttaaaacatctaagcaatttaaaataatccctgttgagtttaaattcgagatgcatttaggtaaattggataaattcaacatttgaataaatccgtcaggttttagatggtgggattgatgaactttggtactttctcaatccaaaactaatttatttggaactagtacgttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttga

SEQ ID NO: 3329 - DNA, 2402 bp, Homo sapiens
actgcctctagggagttctggtccctttggactcaccggctccttctttgtgtcttgttcccgtttctgggctcggagcttctccgctaatctctgggcatttatggccgtagaggcagcggcagcggcacaaaatggctttgagacgagagtgaagagactcccgcaaccttggccgtttccccggatccaggggcccgacgcgctccacctgggcgccgccatcttacaaggaagggcggggcgagccaagaccacgtggagaagggcgactacaatgaggcgggagtgggtgggccctgcaggtcacgtggtgcggggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctgggc

SEQ ID NO: 3330 - DNA, 1332 bp, Homo sapiens
atgaggttgatactaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactgccctggcgcttcataggttcttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagttgagtatatatattctctcttaagggctaaaagtttataatcatcccttaaacactctgtgatgggatcttcaggatcatcttttgaagtaaactatattttacaatgtg

SEQ ID NO: 3331 - DNA, 2771 bp, Homo sapiens
gctatcattttaggcttaactaccaccatctcctcgcgggcagtgggggcaaccgcgaagacagaatttcacaaactttcagctccagcagtttcaaggaaatgtcaaatgacaagatggaagaccgagtgtcaagagctaagacaacaaaaaggcccccaaaatttgttttcaagaaaaccaatgaaaaaagcaagcaatcagaacgtgaagtccaggatcatggatgtgcttatcttcacagtcactgctgggtcctgaagttctcctctggcccagtgccagctgcgaagccctctgccaaagggccagaggaggccggtgatatagagctctgattacccacccgtcagggcaccgctgaaggtcactgaatacttactgtgcacccgaaaaataaatcctgcgagttcacgcccgcgtagttcgccccctgattttgagcgactcctttcgcatgggatctacaaaaccgaactgccttaaagacctctttcacacggacgtgaagtcacagaactgacaaaatcccatcctgtcaaagtgcacgggtctttgaaatctaacacaaaaagccatagaaagattctctaaacaccctgtactaagaggaacacggacagggcactgcgttctgaagtagaggccagggcactggcccttagacacgtctcgctgtcaccgggctaacaacattggcaagggcggcggcagcagcactgatatttgcagcccccaagggctctggcgaaaccccctctattactctgtatcctgcctgcttccaagatgaacctgttgctgggaaagaacaggctaaattagaaaagggagtattttgtcaaagttgaaggtgagtgatagcctgcccgcctcaaataggatgggaaaaactaaggatattggggatgatgacactgtcgcctccgaattctggtccggggctctctcccagccctcaagtgtccccacgcggccgcggaccccgaacagggacagctggagacgggcttgggcagcgcgcggcctgcacccgcggccatccatcttgcagcccggcccggccaggctatcccgggcaagggctgggggaactcgctgcccccagcgccgccacggccgggcgacattctgcgccctgggaagggggataggggtgcggcgcggccccggtccccggcccgcccggatccccggcctcaccttgacgtggaagcggatgagcgccaggcggatgcagtgggccatgcagacgggcggcaggaaccagacctttggcggcggggtgcccttgttctggacatggctgacgatctgctgtgccgtctggcgctcgttgccctgccgcttgacccactcgtgcagccgggccttctcgagcgcgccgttgaagaagacgaagagctcgatgttgccgccgaagcaggccttggccagcgccgccagaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactgccctggcgcttcataggttcttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagttgagtatatatattctctcttaagggctaaaagtttataatcatcccttaaacactctgtgatgggatcttcaggatcatcttttgaagtaaactatattttacaatgtgatataaa

SEQ ID NO: 3332 - DNA, 1617 bp, Homo sapiens
agattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagag

SEQ ID NO: 3333 - DNA, 3646 bp, Homo sapiens
ggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaattttttcctttttttttttaaccggaaagtgcatttgcttgggtgtaatcctaaagtgaaatgggacagtgccttgcagtctttgcccactatacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaattaagacaaaatgtttaataagaatagcaaaaatttttttatattatgcatccttatacctcacatatcttccttaactagatagtttgacagaaagaatggcatacaaagaggaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcaacacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctcctt

SEQ ID NO: 3334 - DNA, 2706 bp, Homo sapiens
attggagtggccgctggacgcgtgcgcaggacccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattt

SEQ ID NO: 3335 - DNA, 3523 bp, Homo sapiens
cccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgttgctgtcatcctcacctaatcgtattcctagtagcagactgcatcagatcaaaagggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattt

SEQ ID NO: 3336 - DNA, 264 bp, Homo sapiens
agtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgcttcacatatggcatttc

SEQ ID NO: 3337 - DNA, 4246 bp, Homo sapiens
ggaagagactgcaggttgtagattttggtcttggccccaacgggttcccccagaccattagaacccgagagaggaagaggaggcaccgcggcggcggctgagaggccgaacccccaacctgtcctcgaggcgggaggggggcagggaggggagaagcaccgatcccagggctgaggagcctccgggaccgggtccgggagcatggggggctggaccgggtccccgagcatggggagctggagccgccaaggccgcccggccgggtcctacccgactgtcaggtcctcggtgctagcgctgcccgggcagccgcagcatctgtagcccggccccgcttgtggtcctcagccggaaagatagcagcatgagttccgccgctgcctagtttcctccccctcctcttctccctcctctctcctcttcccagaccacctccttctttcccgcccctgcgcttcttttcccttaccctctgtcctcctccctcccctctgccctctcccttcccctccctcctccgcccccttcctctccctttcccccctctgccctcctcttatcctctctgtcctcctgcttttccacctatccttttccctccctcttccctcctccctccatccttgttttccctccatccttctttccttcatccttttccttcattctgtcaccttccaccactacctcttcgtcctcctctcctgcctcaccatcatcctcccttcctcatcatcatcctccttccctcctcctctcctacttttctccgcccccagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattta

SEQ ID NO: 3338 - DNA, 2706 bp, Homo sapiens
attggagtggccgctggacgcgtgcgcaggacccgatgggtgcccggacgcggaagaactggcccagcggaggttcccgcttctgaagcgtgggaggcggaagagactgcagcccccgcccccgtccccaagcctccgccccttagcccccgcccccagctgccagtccccagcagctcagtcctgcagtgagagtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctgcttttggtaccaaaaggatacatggagcgtgtagataaaatatacaagcggcatcaggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaattt

SEQ ID NO: 3339 - DNA, 1381 bp, Homo sapiens
agtcttgggagtccatagctaagcaccaggagctgagcactgcccgctgtgcctgcctgcaagtctgacatggctcaggagaaaatggagctggaccttgagcctgacacatcttatgggggaaccctgaggagatccagcagcgctcccctaatccatgggctcagtgacctttcacaggttttccaaccttacacacttagaactcggaggaatagtacaacaattatgagccgtcacagcctggaagaaggcctggatatggtgaacagagaaactgcacatgaaagggaaatgcaaacggcaatgcagataagccaatcatgggatgagagcttgagcctgagtgacagtgattttgacaagccggagaaattatattctcctaagagaattgacttcactccagtttctccagcaccttcacccaccaggggattcggaaagatgttcgtgagcagcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcaca

SEQ ID NO: 3340 - DNA, 1368 bp, Homo sapiens
ggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 3341 - DNA, 1344 bp, Homo sapiens
gcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaa

SEQ ID NO: 3342 - DNA, 2119 bp, Homo sapiens
gaggaccacaagcggggccgggctacagatgctgcggctgcccgggcagcgctagcaccgaggacctgacagtcgggtgagggcctgggacagacgcagcagactgggatatgcaaagagaggagtagcctaattgtcaagtctagatctaacaaaagcagtgtcccaagatcatggcatatttccctggaactggaaggactgatcaagaaacacagctagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 3343 - DNA, 2247 bp, Homo sapiens
gttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagcagtgtttctctccatcattacaaacttgtgtgagttgcactggttcgccttcaagtcctattcccagtcctatgcaacaatacatcataagaagtcaaaatcctaccaacattattagaccaagtatccttggaccattaaaaagaaaaggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 3344 - DNA, 10055 bp, Homo sapiens
aggcaaactccaccccggggagctgttgtgcttgcattgctgggctgctgatagactgattgagtggtggcgtgtacttttgtcacaagaaccataaccacaatgacagccacacagcatggacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattgcgttgtcgtttttagaggcatttcgtgatccatggttgcgctcccgtgaagagcgagtctagagaaggaatccgaagcggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcaggaaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaaccctttgctgtatcactgtgtggaaaatacctccaaagctgaaagagccaggtatttacctgatgagcagaggggaccactgattggcagaaaacttccctacgttcagttgttagatatgcaaattgataaggatctaacactaggaaaataaaggcgagttttggtttggttggtttcagtcatttgtttggggagatataaaaggctcaggagagcaggcttttgcttttgcttttgtttgtttcttcccccacccagtgcagaaatcaggatcagggaaagattttattaaatgccaatagatacagtatttaagcatttataaactgaaaccttttcatgtgaagataatgcatattttaccgtttatccagctgttaacattttgtaatcagtcaattcaatagaattattctggataattctatatctagaatataaaatctggtcttatagctagacatgatgatggtccccaaaccattgatgttctgttatgtactgtaatgggaagcgattctgattttgttttatatgggttctctggttctcaaaaaaaaaaaaaatctattgtgctggtgtcccagaggaatggctctgccttgttttgggtaagagtctgtttctcaccccaaaccctgttttcagatttttttttaccttgattgtaaaatttcagatccaaccattcctcaatataatgagtgcaaaatgaggaacacataaagaaaaacaatagaaagatacagtttttcacatcatttgccttttgctttatagacttatgacaaagacaagtgtgttcagaatatgacactggcaagcttatgtattgtaaacactttatgccaagttttttttgaaaagtggtttgcttctatgtatgttttctaatatttcagatgaaacatttatttcagaaagggttattatatgcctagtttgaatgataaactgaagcagttcctagaatgctattagtgtctaatgatgaaattaatatcctttttgaaatacacttcagtgtatttaatcaaaagaccagagcttctactaggaggtgattcatcataccaggaagattatgcatattcacgtgaaactgcacatatgtaaatgacatgaacacttctgtataagtctcatttccagagagattgcattagtaatgaactgttattacatgctttttaagtttgttttctgtttcataaatgaaagaacaaggcaagttaaatatatgaaaacctattttaataatatgaagaaagtaacaaaataaatggacatcaaaggaaagcaaattgagccagtagcagaaagtaggccattccccattttaaatttgcagtgattcaattaggagaggtttgctgaatttcttcattagtcatatgactggcttttattgcattgtctcagatccataatgttatttcaaagtaatcttttaatatttaatttctttatgtgtgtaaatgaggccctatatgcagtcatagccttaagcattctgaacacactaccaagaattcatataagcatctcacactcacgtgctcatgcactcaactgtgtacagactaacagacaaaagacatctactctagatctggaaattatttttgaaattatttctgtattaaacaagggatttacatttgatttcatgccgctggtactatttaggctcaaaatacattcatcttcccctagtgaatggagaaaatataaattttattcctagctgtaaaacaaaggatcttgatttccttgttgtacattttcctgcaagggttatattctcctttgcatgaatccatggcaaagttatgttggttcatttgttcaattgtacaggaaagttaagaatacctgaaaaacttatgagaatattgtaatagtaaaggcaatctatttcttaagcagtagaagaaaagtttttgctttcataattttaggacttaatcctccatttacaccattatgctgtgtctcctctttataagaaaaggaacacgtgagcaaagtttatcttaatttccactgacctgtcaattaaccagttataaaagatataaaatattttcttttaaaatttatattttccactttttttttaccttattttttaagaattgcacccacaccaatcaaataaaggatttgggcaatgaattaaacagcctcaatcacttgatgggaaatccctggagtggcaggaagagtagattctcaactttttccaaccatagaaaagggatcatagttgctttcttgtgccaagggctactttctctcatttgtgttcatggagattgttttttcaagaattttcctagatttacattccaatttttattaatacattatatctaatgaccttgtgaagattattcaggcccatatttgctgactttttaagggaaggattggatagaggctaattatatctttcccacatgtatgtatattctaagatacttggttgattgacttcctttagttgaaaggctgcccaaattagacaggaaaaagtcaaatcaattgttgggcgaaaatttatcggttggtttaatagctctgcacaaagacagcctgacttgaatgtctatattacacatacactgttatttgaaacactctgctttagtacagatggtggttgatgcgtttatcctgccattagcaccaattgggagaaattttactacagcattttaaataatcacaagagtaaatagatttctattattttatctaataacaacaatagaatatagaatacaaaggacttcctctagatacattttattttatctaataacaacaatggaatatagaatacaaaggacttcctttagatacattttccacaaattatctgcttatttaaatacaaagggtttaatatctatgaaggtaataactcaccgtgtttaaaggatttatttcttcatctcagaggtagtcttcaagtatttgcagttaaacagtatgcaaatagccctttgcttacacaattatccaggtaaaaagactatgtcaggtgttgagatttctttgaattttctaagagttttcattatttacgcctttgtcagattaattttaaaggcaactcttgactgttagcttggtgtgaagagatccactcaggcagctcatgtctcctaagtgccctcagacagcagtgacgggacacttcacatgacgctagcatgttggctctgtccgcatggcggaatgcattccctgctgttagttatctgaatttttctcctgaattacaaatatatggatttggctcccctgatgctgggcttctgctgagacctgttccagtacattcacgtatgctttgctccccttcattgttaagaaattaattcaagaagttttttgctgttaaacataaggaataagcatcacaattgcctcatctcatcactgaggaaagctggtttaaagtatctgagtgaaataagaggaaaaccccaaatacttcacctaacccagtttccctttcccctcctccaggcagagcaaggaaaagaacagttgtaatttgtgtaaactcagccttagaaaatttcaattcattacacacaaaaatatttatgaagcagtttggaaccaaaggggtagtatggtagacgagtgtcttacagagcctgtgtggggaagcaaaaggcaagggtgtagttcacaggcagaagcgagctgtgacattgtcagtgcagcgtgtaagtgtggctcctcacaggcggccattgattgtgagacctcatcttgctctgaagatttcccggtggctgtcatgcattgcttctcaaaagccttgcactgtgataaggtttaaggagacagattgttgcaacaatagccacttctaaggaatgttattatgtcactgcagatgatgtttttaagaggtgattcagaatgatagtttcgtgattacggaaaggagttccttctcaaactgcaaaaggaaagatgaaaatagtcatgaagcctccagaactgaaattgggcaccttttatgatggatatttactttaattcaatgcaacacatatttatggggcatagactgtatcaaatacttaataaaacccattcagtttggagctcacacctaagctgcgctgtaattggattttcttaatattcattaaaaacacaaaacaatattattttacttttttttggtatttgcatttgttgcttatagtttgtggggtgaagcaaagtggtgtgaagttgaagaagggcactatgaattaagccacacaaatgcctctaaaaaatagtaaatgtaacaatggttaacattcattgaatacttactatgtgtcaggcactgctaggagatttagaaataattacttagtcctcttaacagccatgtggggtaggtaatattatctccccagtaagacagctttaattcatcctttttgtttctatccctttccatctctgtctgtctgtctctctctctcttttcccctagtctctaggacagggatataaactctttagtgattttcagtaatagagagctaagcactgcttagtgtcattgtcagctcacttctaatagaaagagctaacccatgtccacgcagctgaaaattagttttgtgtctgagatgatggtgctcacaatcatatacagggaaccctgccactgtgctatgctgagtaggcaaacattggccttcccttggagggatcctcttctcttaggattaatgtgggaagtacagacagaaatctcttctgttgtcatggcgatacttcttccctgacagggtatcattcattcaaagcatatttgtttcatttgtttttattcctaccttaagccatcttggtgggttctgggtggtctatgcatatgtgtgtgtgttttaattgcagtaagaatattgaatatgagatctaccctctttaattttttttttttttttttttgagatggagtcttactctgtcacccaggctggagtgcagtggcttgatctcggctcactataacctccacctcccaggttcaagtgattctcctgcctcagcctcccaagtagctgagactacaggcgtgcaccaccatgcccgttagtttttgtatttttagtagagacagggtttcaccatgttggccaggctggtctcaaactcctgacctcaaatgatctgcccacctctacctccaaagtgttgggattacaggcaatgagccaccacgcccgggttaccttctttaatttttaagtacacaatacagtattgttaactatagccacagtgttgtacagcaaatctctctcacctatgcatcctgcgtaactgaaactctgtgcccattgaacagcagctcctcatttcctcccccatcagcccctggcagccatcattctactctctgcttctgtgagtctggctattttagatcccttatagaagtggaaacgcgcagtatttgtccttctgtgactggcttatttcattgagcataacgacccccaagtttagccatgttgttgcttatggcaggatttccttcttttttcaggctgaataatatttccttatatgtatatgctgcatttttaaaaaccctttcatctactgacagacgtttagattatttccacatcttggctattatgagtaatgctacaacgaacgagggagtgaaaatatctctttaagatcctgatttcagtttttttgaataaatacccagaagtggaatgactgggtcattcatatggtaattctaattaaacatagaattatttttaattttttgagaaacttctgtgctgctttccacagtggttgcatctgtttacatacttaccaatggtgcacaagggttccaatttctccacatctttgccaacttgttatctgtgtttgtttaaatgacagctgtatgagttgtcccttgcctccatgcaattctgaacttcagaaataagcacttggctcctttaatagctgtccgtcctatgttgtgtctacagccactgaatcctgtcctacattttctgattcattaactcattcaactaatagctattgaacaccatcaataagtcagccaccatgaagatgagtattttatattgaattctactaacatatcctgtatgtttactatgttgccagagaggatgctgtgtgctttttttacattgttatctttactcttcacaagaaccatgtaaggtaggtattggtaaaatgggtaattttggaaatgcttcaataatcgagtagaataacttttgctctatgtgagaagatacgttttaaataagatatggcttaggtttctggttacctgagacatactataccttctcagatactctcagacctgaatcatttaacaaactaaggcagaaatactaaaaatatctggttcaataacataggggcatggagtagacatgcagaaaatgcttgttcacttgccttgaaatggctccaggtggcctgaaggaatcaatgaaacttctcaagtatctacattacaaccactggtccccactacacatttatttctaaataaaggaggagaaactctagcaaagtaatatttaacattttcattgcttccaggataaatcttattgaatatggaggatctgatagtggtaggtctatcaggaatatcagggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaaaataacccaaacgagaaactccatttccataattagctttcctgaaagtcaggcatgtctttgaggacaggttttggcagtattatttttgtgcacaggaggaaaattgttagtaggtttatagatgttatttttataatagaatgttaaacccctgaaaaacatcaaaaattgtctcctagaactaattctatgttttaaaaacttgttttaaaaaggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaattacaacactgccattttactgttgtgtttaattcagtcaataaattttgttgctcctttgcatttaaa

SEQ ID NO: 3345 - DNA, 2827 bp, Homo sapiens
cggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcaggaaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaaccctttgctgtatcactgtgtggaaaatacctccaaagctgaaagagccaggtatttacctgatgagcagaggggaccactgattggcagaaaacttccctacgttcagttgttagatatgcaaattgataaggatctaacactaggaaaataaaggcgagttttggtttggttggtttcagtcatttgtttggggagatataaaaggctcaggagagcaggcttttgcttttgcttttgtttgtttcttcccccacccagtgcagaaatcaggatcagggaaagattttattaaatgccaatagatacagtatttaagcatttataaactgaaaccttttcatgtgaagataatgcatattttaccgtttatccagctgttaacattttgtaatcagtcaattcaatagaattattctggataattctatatctagaatataaaatctggtcttatagctagacatgatgatggtccccaaaccattgatgttctgttatgtactgtaatgggaagcgattctgattttgttttatatgggttctctggttctc

SEQ ID NO: 3346 - DNA, 3197 bp, Homo sapiens
ggcaaactccaccccggggagctgttgtgcttgcattgctgggctgctgatagactgattgagtggtggcgtgtacttttgtcacaagaaccataaccacaatgacagccacacagcatggacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattgcgttgtcgtttttagaggcatttcgtgatccatggttgcgctcccgtgaagagcgagtctagagaaggaatccgaaggtgggtgagagttgagggaatttgaattccataattacgactcgaatttctgcaatcagctcgcggctgtgttgcctgctcctgccacaaaaacgccatgcagcgccgagccaagtcggatggaagtgggttagggtattatataagcccttgcgggagggaagatggtcttttatgtgtgtttcttttgcagcggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcaggaaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggtgagcccgcagggggagaggaggtgcccgcccccgccgaccgcgccccagcgcggagctgccgagaggcagagggcctcgcgcaccccggcgacaccggcgcccggggagaggacgccgcggggcatcggcgcgccgagccggggcccggggaggtccgcacggcagaggacgcttccaggacgggggccgttcccgtaaagacggtcccccttgtcgactccgaaggcggcagcggccgggcgcccgccgccccagaccctgcctctgtcgatccaccctcagacccgtcggcagatcgtatttgtttgatgttttctgacgtgacttcactgaaaagctttgactctcttacaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaa

SEQ ID NO: 3347 - DNA, 3273 bp, Homo sapiens
atcagcctctccccagcaccgactgtgcgctcccgctcccccctcctccccacaaccccgccccacactactggcactgctgcctgagccttcctggagttacttaatccaccccagccccaggcactgaaccacgcgtgcagacccctcgtcctcagttctgcggagacagagtccccacagcatttctgctcctccctcaagactgcggcagagcacagcaccagtagaccccacacacagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgaggggaaaagcctgccctccccaggggacccgtcagaccctggggggcggcgaagcaaagccttcctccccccgggtgaggggccggggctggacggcctgtgccaggacctgttggacagcgagctcctggccgatgcatcctttggtctctgcagggccctgtgtgaggacgtggcctcactccagagcttcgactcgctcacgggttgtggggaggtgttcgcagatgagagctcggtgccatctctggagctgaacgagggcccggagagcccaacccaggctgctcagggcctggagagcaaggttcccaggggccctctccagggcagtgtggagcagctggcctcgcccgcccagaatgaagcctctgacttcaccaggttctgggacagtgtgaatcgctcagtgcgtcagcagcagcgtgccctcctaggcccgtggctttcaggcccccaggggacagacagggaccaatcccggctggacacagctgggctcgctgagctgcccctctgcccctgcagggaccctcgcagcggctccaaagccagctccatcgacacaggcacccccaagagcgagcagcccgaatccgtgtccacaagtgacgagggctactatgattccttctcgccaggacttgaggaggacaagaaggaagctgagagcccaggcactcctgccgccaccttcccacgggacagctacagtggggacgccctctacgagctcttccacgaccccagcgagggtcctcttggccccagcccagatgatgacctgtgcgtgtctgagagtctgtcagggccggccctggggacgccactgtccatatgcagcttccgagtgggggccgaggagaacttggccccagcaccaggccctgacctgctcagccagggcttcctacagagctcctggaagggcaaggagtgcctgctgaagctgtgtgacactgagctcgccatcaccatgggcatcgtcagctggctgcgccgaggccccacgccccgtgccccacccacccctgggcagcctgcagctccacctggttcccagggagcccctagggcacccacagagaagctggggggcagggagggcctggcctcagatgcagggggggcgacagtttgctcagcacccagcaggcaggagctgtgggcacacccgggcaccacaggcctgctcgccggagagagcaaggccctcggaggggccacacaagggactggcacactgtccagggatgcctctcgagaggaagagacacgaggtcactctgaaggcttgttctcctctatggagtctgcagccacttcgacaacagatacttccggtaaaaataaggccccagttccttctacctggccctgctcccagaaggagcctgggccaccaggggtcctggggtgtttccgaggcccctggaggccaggtcacggaggtgacactctggatgcagagcccatgctggcaggctgtgtggcccgtgtggcagccctgaagatcagctcaaacgaacagcccccggccgcatggcctccaaggcaagacatgggcagtgggctctttgggcagcgctgggccaggggccctgacatgctggagcagaaacagtccagcagctcccccagcatgaccaccatccatggcctaccctactcagccagcacacaggaccagaggtgtcgagatcgtgtccaggacctgagctggctcagggtggagcccaccgggctaggtgtccaggcctgggcctctgtggaggaccagcccttgcagctcagcacagaggctgtggagcaggtggcacacggcagccagctggactctgagccccgctcagcccctgctgcccggtggagttcccagggccaccatccagaaagcctgggcctcactttgaacagccagcaggaagggggggtctctgcaagtgccccagaatgccgctgcagcctcctggcccgtgagggcctcctctgtggccagccagaagtgggggcctctgggccagccatggctgagccccatctgtaggacaggctcacatgcaccaggaactgcatgtgtcttcatgaccactttcaggagagcctaggactcaaatctctatcttttgtccctgatgtggggactgtgttgggggtggggggtggcaggactcaggcatgcagagggtagcatgttcatgtggaggcatccttgcctgaacccaccagctcaggcagcccaccgccaaagacagcgcgaagctgcaaccacctagctgctcctcatgcaggggctggagagaggggctagggcttgaaactgagggggagaaagagctgcacattgtaaatgggaagcagagagccaatgagtctgcctgggatgtgtgtgaatcccaaaagacgcaatcccaaatgccatagtcccaagtgttgagaatccaaaatattaaaattactatactctaaaatccg

SEQ ID NO: 3348 - DNA, 6172 bp, Homo sapiens
gagctgaccgtggtgctgagcgcggctcgcgctccgacgcggtgcccgagcctgtcgcggccgcgccctgctgcactgcgggcccccagcgcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgaggggaaaagcctgccctccccaggggacccgtcagaccctggggggcggcgaagcaaagccttcctccccccgggtgaggggccggggctggacggcctgtgccaggacctgttggacagcgagctcctggccgatgcatcctttggtctctgcagggccctgtgtgaggacgtggcctcactccagagcttcgactcgctcacgggttgtggggaggtgttcgcagatgagagctcggtgccatctctggagctgaacgagggcccggagagcccaacccaggctgctcagggcctggagagcaaggttcccaggggccctctccagggcagtgtggagcagctggcctcgcccgcccagaatgaagcctctgacttcaccaggttctgggacagtgtgaatcgctcagtgcgtcagcagcagcgtgccctcctaggcccgtggctttcaggcccccaggggacagacagggaccaatcccggctggacacagctgggctcgctgagctgcccctctgcccctgcagggaccctcgcagcggctccaaagccagctccatcgacacaggcacccccaagagcgagcagcccgaatccgtgtccacaagtgacgagggctactatgattccttctcgccaggacttgaggaggacaagaaggaagctgagagcccaggcactcctgccgccaccttcccacgggacagctacagtggggacgccctctacgagctcttccacgaccccagcgagggtcctcttggccccagcccagatgatgacctgtgcgtgtctgagagtctgtcagggccggccctggggacgccactgtccatatgcagcttccgagtgggggccgaggagaacttggccccagcaccaggccctgacctgctcagccagggcttcctacagagctcctggaagggcaaggagtgcctgctgaagctgtgtgacactgagctcgccatcaccatgggcatcgtcagctggctgcgccgaggccccacgccccgtgccccacccacccctgggcagcctgcagctccacctggttcccagggagcccctagggcacccacagagaagctggggggcagggagggcctggcctcagatgcagggggggcgacagtttgctcagcacccagcaggcaggagctgtgggcacacccgggcaccacaggcctgctcgccggagagagcaaggccctcggaggggccacacaagggactggcacactgtccagggatgcctctcgagaggaagagacacgaggtcactctgaaggcttgttctcctctatggagtctgcagccacttcgacaacagatacttccggtaaaaataaggccccagttccttctacctggccctgctcccagaaggagcctgggccaccaggggtcctggggtgtttccgaggcccctggaggccaggtcacggaggtgacactctggatgcagagcccatgctggcaggctgtgtggcccgtgtggcagccctgaagatcagctcaaacgaacagcccccggccgcatggcctccaaggcaagacatgggcagtgggctctttgggcagcgctgggccaggggccctgacatgctggagcagaaacagtccagcagctcccccagcatgaccaccatccatggcctaccctactcagccagcacacaggaccagaggtgtcgagatcgtgtccaggacctgagctggctcagggtggagcccaccgggctaggtgtccaggcctgggcctctgtggaggaccagcccttgcagctcagcacagaggctgtggagcaggtggcacacggcagccagctggactctgagccccgctcagcccctgctgcccggtggagttcccagggccaccatccagaaagcctgggcctcactttgaacagccagcaggaagggggggtctctgcaagtgccccagaatgccgctgcagcctcctggcccgtgagggcctcctctgtggccagccagaagtgggggcctctgggccagccatggctgagccccatctgtaggacaggctcacatgcaccaggaactgcatgtgtcttcatgaccactttcaggagagcctaggactcaaatctctatcttttgtccctgatgtggggactgtgttgggggtggggggtggcaggactcaggcatgcagagggtagcatgttcatgtggaggcatccttgcctgaacccaccagctcaggcagcccaccgccaaagacagcgcgaagctgcaaccacctagctgctcctcatgcaggggctggagagaggggctagggcttgaaactgagggggagaaagagctgcacattgtaaatgggaagcagagagccaatgagtctgcctgggatgtgtgtgaatcccaaaagacgcaatcccaaatgccatagtcccaagtgttgagaatccaaaatattaaaattactatactctaaaatccgaaaatcacaatcccaaaagatctaaatcctggaaatataattctgggaaaatttttttttaattttttaaaagatacttacattttaaaaggatttatttgagaaacataaaaacacaacagaacacatcagccacttcacacaataaaataggcaataatacatatttttggaagcataaacaggtatacagacagttacaccggtgtgagttattagcagacaaactatattcatgaagaaataggtcaaaatgggaaatgtatacatgcatgtcactatgcttggtaattgtgtgcacctcgctttatacttgcagtcatatcatgaccaacaacctaagtcttttgacgaagtcaatctatgatgcgtcaccaccacacacacagttgcccaaagagcggagatggcaagaactttcatctctcacaattgcagatgtacaaaaattacatctcttcatttattgaggaagttttgacgtttttatacacacgcacaatgcttacacacacagtcaacctgggatgccggcagggtggctcaggacgaaagcctcaggacccaggagggccatgggtgtaagttccagagtccaaaggccagcgagcctgaagctctgatgtcaaggcagtggaagaaaagcctgtcccagctctgagagagagaccagtttgccttctttatttgttctccctgggcctcagcagattgaatgctgcccaccaacattgagggtggatcttccacacctaggcccctcagattcacacactaatctctggaaacacctcacagacatgcccagaataatgatctcccaggtctctaggtatcccttaacccagtcgagttcacacccaaaatgaagtccacaggtccaccccttgtcaacttggcatccatccgcatccccttaaaccattttcagtctccaaataaagccccaagcaaggcagtagctccacctaacatgatgcaactatcccgggattgtgatttttaagactttagatgttagggatttgaaactttagagatttgcgtctttcagtatttcaatgttggggaccagtgtttgggattatgtcttttagaataatgatccaaacttgtgtgaggactgtgaggctcagggtgggagacgggtgggggagccgaccttaggagggcccactgaaccggcctcaatctggccccagtctggcctactcgctgccccaggacaggtggctacaacatgctgagggcctgaagggcgtcccctcaggaacattgtattactgttttgtgttgctataaaggataactgtgaccagatcatttataaagtaaagaagtttatttggcttgtaattctgcaggtgtagaggcatggcaccagcatctgctgctgctttttttttttttttttttttttttgagacagggtctcactttgttgcccaggtgggaatgggagtgcagtggcacagtcttggctcactgcagcctctacctcctgggctcaagcagtcctcccacctcagcctcccaagtagctgggactacaggcgtgcgccaccttgcctggctaatttttctatttttttgtagagacgggttttcgccatgttgcctcagctaaaatgtctcaaaatctcctcaactaaaatgtctcaaaatctcagcctcccacagtgctggatgacaggagtgagccagccagcatcatgcatccctgtgcgccctgccagggctggcgggaccctcccacccttgttgatgggcagtgctagattatttgtcacgaatcatcccctacaaacaatgatttccctccgcttgcactctctaactagagccatggatggccaaatgctttttgggaagaagccaatggattctcctcggctctgcctgcaagtaacaaaggcttttgactccactccctccacgctgtcagatcgccattccccttcaggaaaacttcgaatggggctgtggacctcactccccaaaatgtcacaacacatgtgcagcaccccgacattcagaaccatgaagggagaaggtggctggtgtctgtaggagggacaggtgtccgtcctgggccagtgtcaggccagcaggtgcagggacagatgggccatccacattctccaagattagcttctacctcaaccagcacacctcagcaagatgccaggattgggctccacaggcagccatgaaatgggtttctggaggaaagatcagcacaggaaaaggggtcagtcaggtcgcaggcaaagtgctagggaaatcccatctcatgcagagctcccaccaagaggagcgtgagttgtgctgtcctggctcgagaagaaggcagcacaggatctgtagctgagggtggccctcccaccaggggacgctggtcagtgcctctcctgactgcctgacgcttggtctccggtggccctctctcaccagggctccctgaggcctgctgcaagcaggacacaggctgcacatcacaggttccaaagtgtgcagcaaggcttctgaccaggcccgtccagatctggagcccctgtggagccacatctgagccctcctcccaagactcacacacaggaccacagcagcatcactgagccgagctgggggcaagtttcaccagattcgcttacctgatccttgcatcaacctcaatgcagttgtcagccccatttttcagacctggacacggaggcacagggtgctggtgtgacttgcccacagttattagtgtgtgaggtgatgggttttgtcccgtcccagctccaaaggccctgctcttcctcaagctccagaacctctcactgagctcctgcagtgaagtcccccctcagagccctcagcccttcctgctttcaggctccagatgtcagagcacccttgggtgccagccacaagtggccctccagcaggctgagcacccagggggaggctgccctgactcaaccccagcctggggctttgtgctgcacctgagggagtagccgctctgtaaatccttgttgaaagaatgaagtgtcaaaaggt

SEQ ID NO: 3349 - DNA, 599 bp, Homo sapiens
cacagcaccagtagaccccacacagtgagtacctgtagggcaagtgcctctttcgttctcttaataatagagtcaggtcccttctccaagggaagaccctgccttgcagccccagcctggcctgccccttcttgcaggcccgctccgaaccctggcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgt

SEQ ID NO: 3350 - DNA, 651 bp, Homo sapiens
gagctgaccgtggtgctgagcgcggctcgcgctccgacgcggtgcccgagcctgtcgcggccgcgccctgctgcactgcgggcccccagcgcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgagg

SEQ ID NO: 3351 - DNA, 2104 bp, Homo sapiens
gagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcaatggattctccacctggcggatgccatgttgcctgttcctttactgtacacacggtgacaaagaaaagggaagatggagcctccaggttgaacatacctggccctcaggtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtc

SEQ ID NO: 3352 - DNA, 4314 bp, Homo sapiens
gcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcataaaatatattttttgaatattcagcatttgaggtatggtttagtgggtttatacaatttaaatggcttatataattatttgaaatgaaaagaaaacctagtcagccagaaccaatttggcaatttttccatggtatgaaggcaaatcaattaaggccaaaacgttgaatgtgggagagatagtaagtgacttgtatgagggattactgcataataacgtaacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttatacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagcctcagagtcctttccaacacgaccctccaggcagcagttaccaaccatcagtcttcagctgaagcttcaagtctttgccatccttgtaatgacagccttaggccttgccccaagcattctggactctctaacactcagaattgtaatgtaatattctgctctaatttaaatttttaaaaatatagtctcctaattcaggataaggagtaagcaaactttctgaaaagggctagataataagtattttaggctttgccagtcatatggtctcttgcagctactcaactctgccactgtagtatgaaagcagccatgagtaatatgttaatgaatgggaatggctgagttccaataaagctttattttttttttatttgagacggggtcttgctctgttgcccaggctggagtgcaatggcgcaatctcagctcactgcaagctctgcctcctgggttcaagccattctcctgcctcagcctcccaagtagctgcgactacaggtgcgcaccacaatgcctggctaattttttgtatttttagtagagacagagtttcaccatgttggccaggttggtctcaaactcctgacttcgtgatccacccaccttggcctcccaaagcactgggattacaggcatgagccaccattcccagccaataaaactttatttacaagaacagctggtgggccagatttggcccaagggtcatagtttattatcccttgagctaggctgctgcctgaggttgattcaacatcccagctccagtcaacaacaaaaattctaagtctcccgcctaatgctgctgtggtgtgtcatgccaaaaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaaagtcagtgaggcaaaaaaaaaaaaaaaaaaaaaaaaaaa

SEQ ID NO: 3353 - DNA, 2030 bp, Homo sapiens
cgcagaaaccctggggaacgcctgaaaaggctaaacacaagcagttacattatgcacaagctggatgacgtgaccccgctgctgctgtgtggagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcagagatgggagtcttcctctgttgcccagactcgagtgcggtggtgccatcatagctccctgaggtcttcaccttctgggttcaagtgatcctcctgccttagcctcctgattagctgggactacaggcacgtgccgccatgtctggctattttattttatttctagagacggggtctcactatgttggccgagcttgtttagggatgttaagtttgcagtactattgacttaatttttattctttattattatactttaagttctggggtacatgtgcacaaagtgcaggtttgttacacaggtatacatgtgccatattggtttgttgcacccatcaactcgtattgacttaatttttaagcatcttgcatcactgtcaaattttaccacataccaagttagatagaatgctttcttaaaaaaacttgaaattaaagccttcctttgtaaccatcctcgaaaacctaacatagcatgtgtgtatttagtcatgatagctgccgtgcattgcctttccatggtatgtgagcctgggcacttagtagctgtatgactgtgggcctcagtttcttcattagcacaataaaggcacccgagaattagcatcttcctctctcatacttacttacaggaaatgacctgacacttataaagtacataattaagatagtgccaagaactcaattttagctattattgttcatattatgccctatactaaggattctcttaaattgataattttatttaatacttataacaacctatgaagttactatttttcccattttggagataagaaaactgagctttccagggggtcagttatttgcccaagataggaagtatctatctaccctcaaagttcatgtggtcagccgctgcagtccagtgtatgtgtgtaaatgtgcaagcagggggatgaatgtcatgttcacagcaaaatatcctgtggcttctgtccttaagaaatggtcagaa

SEQ ID NO: 3354 - DNA, 2594 bp, Homo sapiens
gagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcagagatgggagtcttcctctgttgcccagactcgagtgcggtggtgccatcatagctccctgaggtcttcaccttctgggttcaagtgatcctcctgccttagcctcctgattagctgggactacaggttcagctgaatccagaacttggtgttaagaatggcatcttgggagctggcatgcttcccctgggctccaggctgacttctgtctctgcaaagaggacctcagaacccaggagccagaggaaccagggcaagaggtcccaggggcattctctggagcttcctgagcccagtgggagccccacatcagacaggtgtgctggcacttcgtggaaaagccctggccggtcattccaggtcagcagcccagctatgggtgcccacctgcacctgtcttctcatcaccttgaatccggggccagaatgaaggtcctcaaccgggaaaacagctttcagaagcttgaggccgagacgaatgttgacaccggcttgaccatcataaattctgaacccaggcagacttattttggcggatttccaagggatttacagaccagccagccaccattctgcttgccagcctcttccttgggggtggctacctccaaaaacaacagtgtccttaaggaaagagtctctcctttgccacttgctggccaaagggaccttggtaccaggaagacaatttcagaatgtctccttcatctgcaagttcagggtgaagaaaaagaagaagatgaagaagaattctttatatagcataaaataaatgtggttttctaaaacacaagatcagataaaatgttctagaaatggagtactgacccagaatcagcctgttagttgttcatctgaggggggctgaatgctccccatgcacaatctgtattgattttatttcaaatgttcaaagtctaaaggtgctgggaatgattgtttatttgccgtcacagtcataagagaacacagccaacacacagggaaaaaaaccgaatgcttttgttccgtggagatgcactaacccagctggatgtgttgaatccagcacctatcaggataattgcattgtatgcaaatgaatcggtatgttatacaacactaattagtgtctgtaatttggttttaatttttacttaggttgcatagctcatccccctggacaatatggactgctatttactcttgaatgctttttaattttcatgtgacctcttttggtaactaggccttgttcacataccctccttgtgattttgtctttaaagttgtttgtatctggaatgagtgaaaatgcaaagtgttttgaaaattataaacagttaattttgttttcctgtttaatgagccaaaatactggaagccagaaaatcaggttgaacatgaatgctaggctctagggctttcctgctcatctgcttctcatttgtttctgcactatgtcaaagaggacagtggttcttgttacaaaccaaagaggaacattgagcacagtgggaaaattggactggttgatctggtcactggagcaggacttgggttcttctggccagattttgactcccagattcctttacaaaacgcactcattcattcatttatatatgttcattcaataaacattttttgaataccta

SEQ ID NO: 3355 - DNA, 2509 bp, Homo sapiens
atgcacaagctggatgacgtgaccccgctgctgctgtgtggagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggctcccttctgcagaggactctggaccagctcctggattgcatttgcccagaggtccggctctttcaggtgtctgaacgggccagtcctgtgaaatactgtgaaaagtcccattccaagcggtcccggtttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcaggttcagctgaatccagaacttggtgttaagaatggcatcttgggagctggcatgcttcccctgggctccaggctgacttctgtctctgcaaagaggacctcagaacccaggagccagaggaaccagggcaagaggtcccaggggcattctctggagcttcctgagcccagtgggagccccacatcagacaggtgtgctggcacttcgtggaaaagccctggccggtcattccaggtcagcagcccagctatgggtgcccacctgcacctgtcttctcatcaccttgaatccggggccagaatgaaggtcctcaaccgggaaaacagctttcagaagcttgaggccgagacgaatgttgacaccggcttgaccatcataaattctgaacccaggcagacttattttggcggatttccaagggatttacagaccagccagccaccattctgcttgccagcctcttccttgggggtggctacctccaaaaacaacagtgtccttaaggaaagagtctctcctttgccacttgctggccaaagggaccttggtaccaggaagacaatttcagaatgtctccttcatctgcaagttcagggtgaagaaaaagaagaagatgaagaagaattctttatatagcataaaataaatgtggttttctaaaacacaagatcagataaaatgttctagaaatggagtactgacccagaatcagcctgttagttgttcatctgaggggggctgaatgctccccatgcacaatctgtattgattttatttcaaatgttcaaagtctaaaggtgctgggaatgattgtttatttgccgtcacagtcataagagaacacagccaacacacagggaaaaaaaccgaatgcttttgttccgtggagatgcactaacccagctggatgtgttgaatccagcacctatcaggataattgcattgtatgcaaatgaatcggtatgttatacaacactaattagtgtctgtaatttggttttaatttttacttaggttgcatagctcatccccctggacaatatggactgctatttactcttgaatgctttttaattttcatgtgacctcttttggtaactaggccttgttcacataccctccttgtgattttgtctttaaagttgtttgtatctggaatgagtgaaaatgcaaagtgttttgaaaattataaacagttaattttgttttcctgtttaatgagccaaaatactggaagccagaaaatcaggttgaacatgaatgctaggctctagggctttcctgctcatctgcttctcatttgtttctgcactatgtcaaagaggacagtggttcttgttacaaaccaaagaggaacattgagcacagtgggaaaattggactggttgatctggtcactggagcaggacttgggttcttctggccagattttgactcccagattcctttacaaaacgcactcattcattcatttatatatgttcattcaataaacattttttgaataccta

SEQ ID NO: 3356 - DNA, 4002 bp, Homo sapiens
agttggcaggctgctgcgggaggcggcggcggtaggaagccggagacagcagggtgacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgctgagggtgtaaatggaggagaggagtctgtaaacctgaatgatgcagatgaaggattttcatcaggggcttccctcagcagtcagccaattgggaccaaaccatcctcctcttctcagaggggaagcttaaggaaagtagcaactgggcgttcagccaaggataaagaaacagcctctgccatcaaatccagtgagagccctcgagattcagtagttcgcaagcagtatgtacagcaaccaactgatcttagtgtagattcagttgagctgacaccaatgaagaaacacctgagcctgcctgctggccaggtggtgccaaaaatcaatagcttaagtctaatccggacagccagtgcttcctcaagtaaatcatttgactatgtaaatggcagtcaagcaagtaccagcattggggttggcactgagggaggtactaatttagcagccaacaatgctaatcgatactcaactgtcagtctgcaggaagaccggctaggtcaagctggcgaaggtaaagagctcctcagcccaggagcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgcctttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatggtgtgtatatgtatatatcacaaagttgtattttaaatattttaaataccctttcttttaatttaagggatgtcaaataaatgaaaggagtttaaaaatagccaaaataaatgagctataaaggcccataacatactaaaacaggcagtttcaggtatgtaaggaaaggaacattatacttacctagaaagtgagatctaaaaaaaaattaaa

SEQ ID NO: 3357 - DNA, 692 bp, Homo sapiens
ggcggcggtaggaagccggagacagcagggtgacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccag

SEQ ID NO: 3358 - DNA, 536 bp, Homo sapiens
aaagtgctagatgaagaggggttttcttctccttcggccgcggaaactacagacgggagctggcgagggtggtctggaaaggcggtagccggtgtgttggtggtcccggaacctctcgtaaaccagatggagtttcgctctcccaggctggagtgcaatgctgcagtctctgcttactgcaacctccacctcccgggttcaagcgattcttctgcctcagcctcccaagtagctggggttaaagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttac

SEQ ID NO: 3359 - DNA, 1244 bp, Homo sapiens
ttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgagctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaatagaaa

SEQ ID NO: 3360 - DNA, 2017 bp, Homo sapiens
tacgcctcggtgcagcccccggcgaagcccagcgcagctcagctaaactcagcggagccagcgcggcgcgatggaaggtcgagtgcagctgatgaaggccctcctggctcggcccctccggcccgcggcgcgtcgctggaggaacccgattccctttcccgagacgtttgatggcgataccgaccggctcccggagttcatcgtgcagacgagctcctacatgttcgtggacgagaacacgttctccaacgacgccctgaaggtgacgttcctcatcacccgcctcacggggcccgccctgcagtgggtgatcccctacatcaagaaggagagccccctcctcagtgattaccggggcttcctggctgagatgaagcgggtctttggatgggaggaggacgaggacttctaggccgggagaccctcgggcctggggaccggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgccagctcagcccctcccatgcacatttggacgctgtcctgcgctccagttgcacaaagctgagctcctgttacacactgacagaccactgacagccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgccacatggctgccagggctcagttgtgcctggcagccaaatcgagtctctcattttctcttgtggaccagttagttttgcccagaatccatttctcttctgaatttgcagcattttctcaggtgctttttgatcaacaaaataacttgtatcttctgcttaactcctttatactacctggagaaaagtattttccatattttcaataaatgtcagacactattgagaaagaaatagagtctgaatgaatatggcacctttccctccctggtcctgtaaatgtggtccatatcttgttcagaagcgatatcccctgccattcagtgactgatgttgactcctgcattataaaacatctaagatagagtcctgtggtaacctgggggatagtgtccccactggtgatccttctgtcccagatgttgaatcctctaaaccagttaggattatcccaagcctcttagtaaatgaatcgttacctcattttggtcaacactatgtgagaagtcagccagcaggctcttggaaaatgtatcctcatttccagaaagtggtttgaaaacacaattcccaaattgttacaaaccataaatcccacacagattattggtgaacagctgtaaaattttactcaacccatgattcagggaaccaacagaattatataggtgcttttcaaaagcatttataaattcttgattatgtaggtagtggggggaaatgcagaaatgagatcattaatttagatacaaacctggttgatgaccagggggttttattttgcagaagaattgggtatttggtatcattttattcaattacatgtgatcctggtacatttcataagcttgggtaaaaaaattttttgttattttccatgcacaataagggaaatgttttaattggctttgtgcctcctgctttacaacagttctggcctcaagttaccaggtagcctgaactttgattttattttaccattaaattgctttaataccattgta

SEQ ID NO: 3361 - DNA, 624 bp, Homo sapiens
atgggaggaggacgaggacttctaggccgggagaccctcgggcctggggaccggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgccagctcagcccctcccatgcacatttggacgctgtcctgcgctccagttgcacaagctgagctcctgttacacactgacagaccactgccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgcc

SEQ ID NO: 3362 - DNA, 1920 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaagacggagtctcactctgtcgcccaggctgtagtgcagtggtgtgatcttggctcactgcaacctccacctcctaggttcaagcgatcctcccatctcagcctcccaagtagctgggattacaggcacccgctatag

SEQ ID NO: 3363 - DNA, 2219 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccatttt

SEQ ID NO: 3364 - DNA, 2507 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgcacttcataggcttctttagctgtcttccttttaccccggacgggatgtagatgttaattctggaacaattgcagctacaagaatttgtcatcctgccccttttgagaaaaacattgtttgcccttgggtctaaatccttccagatgggatgggatgtatcttgtcacctcctttttcttacttaatatgaaaagacctttcctc

SEQ ID NO: 3365 - DNA, 2111 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgcggcagatctctcgagagctgggccctcaggagccgaccggaagccagttgctacgcagcaaaaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggccaaaacggatgtgccatctttaggcttttgtaacccctgcaacttcagaaaactgtaccatttt

SEQ ID NO: 3366 - DNA, 1822 bp, Homo sapiens
aggcggtggtcgtggggaagggaagaggagccccgggagacgacagcagcatgggtgggcggccttcgagccctctggacaagcagcagcggcagcacctaaggggtcaggtggacaccctgctgaggaacttcctgccttgctaccgtgggcagctggcagcgtctgtcctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagatgaggaaactgaggctgagcgggaaggaggggcttgtcccaggcagccagactctggtgcccagatccagccactctgcccaccgccttctccaggaacattccggagctgaatcttcacccacatctatcttgtttctattggataaatgtctacaagtggaatttctgggcc

SEQ ID NO: 3367 - DNA, 2004 bp, Homo sapiens
agccgaggaacgcaggcggtggtcgtggggaagggaagaggagccccgggagacgacagcagcatgggtgggcggccttcgagccctctggacaagcagcagcggcagcacctaagggaagctgccccgagtccgtgagcaccgaggacccctgacccagcttcggggccacccaccccggtggcagccgatcttctgtgttctgcgtggggacggccgcctagagtggttcagccacaaggaggaatatgaaaacgggggccactgccttggctcaacagccctgacaggatacacgctcctgacttcccagcgagaatatctccgccttttggatgctctctgccctgaatccttgggagaccatactcaggaagagcctgactccctcttggaagtgcctgtgagcttcccgctgttcctgcagcaccccttccgccggcacctctgcttctctgcagccaccagggaggcacagcatgcctggaggctggccctgcagggtggcatccggcttcagggcatagtcctgcagcgaagccaggcccctgctgcccgggccttcctggacgccgtccgactctaccggcagcaccaaggccactttggcgacgacgacgtgaccctaggctcagacgccgaggtgctgaccgcggtgctgatgcgggagcaacttcccgcgctgcgagcccagacccttcctggcctgcggggggcaggccgcgcccgcgcctgggcctggaccgagcttctagacgccgttcacgcagctgtcctggccggggcctccgccgggctctgcgccttccagcccgaaaaggacgagctgcttgcgtcgctggagaagacgatccgcccggacgtggaccagctgctgcggcagcgggcgcgtgtggcggggcggctgaggacggatatcaggggaccgctcgagtcgtgcctgcgccgggaggtggacccgcagctgccccgggtcgtgcagaccctgctgcgcaccgtggaagcctcgctcgaggcggtgcggaccctcctggctcaaggcatggaccgactgtcccaccgcctgcgccagagcccctcaggcacgcggctgcgcagggaggtttactcatttggggagatgccgtgggacttggcgctgatgcagacatgctaccgtgaggccgagcggagccgggggcgcttggggcagctggcagcaccgtttggctttctggggatgcagagcctcgtgtttggggcccaagatcttgcacagcagctcatggctgacgccgtggccaccttcctgcagctggctgaccagtgtctgacgacggccctcaactgtgaccaggctgcccagaggctggagagagtcagggggcgcgtgctgaagaaattcaaatcggacagcgggttggcgcagaggaggttcatccgaggctggggtctctgcatctttttaccttttgtgctgagccaactcgagccaggctgcaaaaaggagctgcctgagttcgagggggatgtccttgccgtgggcagccaggctctgaccactgagggcatctatgaggacgtcatccgggggtgcttgctgcagaggattgaccaagaattgaaaaagacccttggtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgacctttccacctatttccctccaaccccaccttccgaaatacatttgctcaatacatttgc

SEQ ID NO: 3368 - DNA, 5465 bp, Homo sapiens
ccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaa

SEQ ID NO: 3369 - DNA, 3214 bp, Homo sapiens
cccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattcc

SEQ ID NO: 3370 - DNA, 3098 bp, Homo sapiens
gcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagcgtcatgccctatcacttttcccctcattgatttcaaaacaatgcatctgcagagagatggggaggagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagcta

SEQ ID NO: 3371 - DNA, 572 bp, Homo sapiens
gttttctggacgggaagaagagggtggtaaaaagcctaccatacttgccgactgaaagggacatctacagggctgagtgtttggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctatta

SEQ ID NO: 3372 - DNA, 529 bp, Homo sapiens
atggtttactctctctgatgaaatgtgggagacactgtggcctctgtagcccatttacagatcatttcataggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggccgggtgcggtggctaacgcctgtaatcccagcactttgggggccgagacgggcagatcacgaggtcaggagatggagaccatcctggctaacacgaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatg

SEQ ID NO: 3373 - DNA, 530 bp, Homo sapiens
gccgactgaaagggacatctacagggctgagtgtttggattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggccgggtgcggtggctaacgcctgtaatcccagcactttgggggccgagacgggcagatcacgaggtcaggagatggagaccatcctggctaacacgaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatg

SEQ ID NO: 3374 - DNA, 590 bp, Homo sapiens
gtagcccatttacagatcatttcatagggtgttgatctaccggctgtcaaggagtccaaatggaagatctcaaagcccttaacagactataacaaagaagagattggctgaatattcatacccttattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaagga

SEQ ID NO: 3375 - DNA, 669 bp, Homo sapiens
actccatttcttggaagagccagcaatacatctctctaatgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagctt

SEQ ID NO: 3376 - DNA, 3456 bp, Homo sapiens
gtgcagacagcagcccaaggtagagcgagcgtgccgggcgagcccggagacttgccttgcaatgccatgtttgtgtatgtgctcactcccggagagcaatcagggagacggctccccggccagacttggctgatgttttcttgtttctgtttcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattatattt

SEQ ID NO: 3377 - DNA, 3327 bp, Homo sapiens
cggagacttgccttgcaatgccatgtttgtgtatgtgctcactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattata

SEQ ID NO: 3378 - DNA, 3031 bp, Homo sapiens
gtgcagacagcagcccaaggtagagcgagcgtgccgggcgagcccggagacttgccttgcaatgccatgtttgtgtatgtgctcactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccgggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgatt

SEQ ID NO: 3379 - DNA, 1963 bp, Homo sapiens
atgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattgtaagtcaggatacttgcatgctgttactttgtactgatgtgtagttaacaggatgtcacatagtagtacaagagttataaaagacccttcatggcagtatatactgcaaacaaggctagttgtcatttcaaaaagtgaaaatttggtcttctctaaccccattactatatttaacagtggctgatattagaactattgtaaaataggaacatatagcacttgtatgtctagagccaattttaacatttgctttcattatcttgggtgaaaagaaatgatagatttcagtttggcattttctaatttgtaacacagctagacaaaacagagcctttctgttctgtgtgttggttaattttttcctttaatcagaaaattaacaatatattcttgatataatgcaacatttgtttttggtaccatttgaccatactgtacaagatatgagaagatttatttcaatagaaaatataagtactgaaattgaattaggctacttttaataaagaatgatttatgggaatacagaactagaaaagcatcacaaatcctactccatcaatatcaaaacagttacttgttcaagatatcaatataaaaaggaataaatattaacaaatataaatttaa

SEQ ID NO: 3380 - DNA, 2110 bp, Homo sapiens
aaaattggtaggagacatgtggaagaaagcaagtctcccgggtatttcagcacttcggcagaaacactggggcattctcattgccagcctcggggggtggctggcacaaagagcccaagattaaacgcggcgcctgggctggcgaggtcggggtcgtgtggtaactctccaggtgctcctcgctggatcccggggtcccagccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaag

SEQ ID NO: 3381 - DNA, 582 bp, Homo sapiens
attctcattgccagcctcggggggtggctggcacaaagagcccaagattaaacgcggcgcctgggctggcgaggtcggggtcgtgtggtaactctccaggtgctcctcgctggatcccggggtcccagccccgccgccgcgccccgcccagctctgtccccgcagcctcgcgggctgccgggctttgtggttcgcccgtgccgctgggcccctgctgggggtgtcgttacgagcatgtgcagacagcagcccaagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagt

SEQ ID NO: 3382 - DNA, 459 bp, Homo sapiens
attcacagctctgtagtccggggctgggcgcttcctctctgggactgaaataagagcgctctagacagatcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcag

SEQ ID NO: 3383 - DNA, 3823 bp, Homo sapiens
tttactgtcgttcctgcctcctccgattcgctttgttcacggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatct

SEQ ID NO: 3384 - DNA, 4295 bp, Homo sapiens
gcggagccgagcggagacagccgcggcgctgcagagcggctggggcggcggcgcggctcccggtgctccccccggcgcgcgccccgagtcgggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggc

SEQ ID NO: 3385 - DNA, 5856 bp, Homo sapiens
ggcggggcggggccggctctttatttacctttgacgcggggagggaagagaggcgcctcctaatccatcttctccctccagcttctgcctggctaccgcccctgacccccacccaggcacccactccactctcgccgctcagcgaattcatccggccctctcccaccccctcccccattcttcccctttccaactcccaatttctcccgcctacacctcccggtgacctcaggctgagagaataattcgtattattattacaaacaaactcactctccagaagcctgatttccctgagacccggtttatttccatggataccccctcctcctctgctttcaccccttctccgcggctctctccctccccgctgccccccacagctctgactcagctctccgtctctcacaaaggccacctcccgctcccctctccccccgcaccccgccctcccctgtctcccttctcctcaggctcttctccacctgccccattcctgctgtgtccggagggccatctttcctcttttcccccagtcaccaccccgcggagccccaggggacagcaggccaactttggagggtcctccctcctcagtccggttcaccacaagccccttcctttcccccagccctgctgatgtgctgaatgcctcctcgtgcccagccccattcaatgctccccttcccaaaaatggagccgacccctaaactcacaattgtaaaacctcatgagtataaagggcctgtacggtcagatggttcaggcagccatctgctgcttgaatagtccctttatgaagacccaagcagttcttccgcaagactctccgcggcaccatcctgccctcagtccaggagtctccctccaccaggagctctggcccggctgtaacaaggaccctccttcccctgagtcctgcagtttcccactcagccctcagaccctgtccacccctcccaccatcttctgtcttctctctgacttgaattcctattttcttaattcctattttaaaaagttctcttttctcctcctgctcaccagcttccctccactttaatccatcacttctctccccacagtcaggtgaaatgcctccagctcacccttggtttctctgctcactgtttttgggaggacacacccaactccttgctatccaactcctgcctcgattcccaggaagtcctcttccagtcagtcagactcatggactcttaggaagggcccaccgggggagacacatcccttccaccctaagcatagagaaaagttcctcatagagcagctctgcccttatctgtagacttgtaatagagaaaaagcccagctcccatacagaaaccctccaagagtcctcaggacggaataattggttttctgataaaacccaacctctgacccctccacataaacaacaacaaataaggccatacatcactttttctgagtgcactattctgggttgagctaaaactgaatatttgggctcagcattactacttgtctcccctagaatttggagagtgcagggatataagaggaaatgggcagctggggtaaggaaggggtgtgaagggctggccccagggtgtcgcctcggctgcacagggaggtgagggccggcggctaaccttctggccccctcagggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtgg

SEQ ID NO: 3386 - DNA, 4382 bp, Homo sapiens
ggggagggatggagaggggaggggggagcggagccgagcggagacagccgcggcgctgcagagcggctggggcggcggcgcggctcccggtgctccccccggcgcgcgccccgagtcggtgagggcccggctctgcggcccccggagccatgggctgcatcggctcccggactgtggggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggca

SEQ ID NO: 3387 - DNA, 4349 bp, Homo sapiens
atctctctctccctctccgttgccttttactgtcgttcctgcctcctccgattcgctttgttcacggaatgaggtgattgcagtggattggaagggcctgaaggatgtcgatcaaatcaacatggacagcaccagctcactgcacgggagcagcctccatcggccatcgactgagcaaactcgaactgatttctcctgggacggcatcaacgcactgtgagcactcacgttctcaacctgtgccccagttttccagagcactggggatatatccctccttgggactcttggctctccatggaggacaccacttccattcttccgaagcttaagcgaaactctaacgcctatggcattggggccctggccaagtcatcattctcagggatctcacggagcatgaaggaccatgtgacaaagcccacagccatggggcaaggccgggtggcccacatgattgagtggcagggctgggggaagacaccagctgttcagccacaacacagccatgagtccgtgcgcagggatacggatgcctactccgacctcagcgatggcgagaaggaggcacgttttctagcaggcgtcatggagcagtttgctatctctgaggccacactcatggcctggtcttccatggatggtgaggacatgagtgtgaactccacccaggagccattgggctgcaactacagtgacaactaccaggaactgatggacagtcaggatgccctggctcaagcacccatggatggatggcctcactcttacgtgtcccagggtatgtactgtctggggtcgtcagatgcctgggaagccagcgatcagtccctcattgcctctccggccacaggatcctatcttgggcctgcatttgatgactcacaacccagcttgcatgaaatgggaccttcccaaccagcttcaggatactctgctctggagcctccacctttgctggggggagacactgactgggctccgggggtaggcgcagtggacctggcaaggggccctgctgaggaggagaagaggccattggcacctgaggaggaagaggatgcgggatgccgggacctggagtcactttccccacgagaagaccctgagatgtctaccgctctcagccggaaggtgtctgacgtcacatcctcaggtgtgcagtcctttgatgaggaggaaggcgaggccaacaactagtttcctcccccaatgccctgccttccactcccacctgagggccatggctgtgacccataccctccctccccccagcagtacagctgaaactgggcagacaacattggggaacccaggagcttccagtcctctcctggaaatggaggaccaggatgggattttatccaggcttacactctagaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcagctgtgctcaagactggatctcagttcttcacgccccgatttcgtcttccaggagctgtaactctgctgtctgaatgcctcctttctccatttcactcttgcttttcccaactctgttttctctggctgtggccccagctcatccctactgagagaacagacctcaggggctgttggacatggctggacaggcgcaggggaggctgcctgaagggcacgtccatggggagggtggagaggctgcctcagcaggtcatttggcttctgagatcaggagtcgaggaggaggtggatgtggcagctgagatctacagggggcacggatgtggttctttctatcaaggcctgcccggagacaagagagtcactgaggagactaagaacaaacacagccccttgctctgggatctttaatatcccatggctaaaaggaagatcctaaggatctgggaaaagacccagccagggctggctgctccagctcttgcttccctttcagctttcttccatccctgctccgggagcctgaggagggtgtggggacacccatcttggatacaccaacgcaggatgcaggtgtcgccaacagcagggggagcatgagggctgtctccccttattcacccctgtcctctgaagctgtttacacttttctctttgccttttctacatttttataacttcttgggcactcagggttgagtggagtggagggaggagtccggtgctgtcactccctcagccaggcagggttgcagctgagggccagggtgggcactcggcactttctgccccttcttcagctcctcccaggactcccaaacagcctcacagctgtcctccctgcctccccaggcctcctaccagaggaagagaggaaaatcagcggattcttccttccaggatggtgtatggtgaggcacaagcttgccctcccacacttggcatccatgctggtggggactgagcagcatatgcgccccagcactaccgtgagagcacaggcagaggatgggcggagcaaagcagcggtgctgtggggttggagagcacttggccctgccactgcccaggtagcccctccccagcccttggcacaggcagagttcgggtaggagagagaggcctaagaggctcactgccctatctccttctttcctcacgcccttccaaggctccggctcccaggcctgtgtcctacccacactctgtcaggagtcctaccacttgcatcctctgctggaagggagcactgttgtcctctcctggccctgggcacaaactttgccctcacccccaggccccagaacttattattttggagtgagaaggttgagagttggggtgtttctgtccatctatggtcctgtcccgccatcaagttcatactctcttactcacacttctgggatgcaagcagggcagggggttctgtgtcttccatggaagggggacaatggttatcctgaggttggtttttggaggaaacatgggcgtaggcaaggtgaaccaaggcaggtgcagtcacctaaccgaatgctgcctgtacaggggaagagtcctcttgtgcttgctaacgtgtgctgactccatgtcccaggacctcatttccaggagctctgagaggtggtctagcatgcccgccctggcagctattccccacccgtctcctgctgcaggctctggggttttgcatgttcatgtgaccttccttccatggggtccctggttcctcaccttctccaatgtgtgctattcccacatcacctcttcctgtcgtctcatcctctcagtgcccatatcatacccccagaccacggtggacagctcacctagtgagtgcgttcattcattacagttcgtttttgctcaggcccgggggagttaggaaaggtagaccacagcagctttcgttcctccttccctttcccaaggaagccaaatggtccctgacaaaagatgactaaagatctgaaggactctagcagggttcatacatgaacctgctttccccagggtgctggcatattgctgcagatggaagtcaggtgggggtctgtcttctgcaaggagctcctactcgctctgaagagggagactgaggagctggcctgggaccatcttaggactcttctggtgctgggggcagggtgcatgggggttgcttatcgtctatttcagggggtggggaggggcatgtgcaggaagaggctgtttcggggtgggaaagggttgcttttcctttggggttaaggctgtgcagcacgttttacagcagtcctggaacagggctgtttttatattcttgtgaatgaaactgctcttgctaaatgattttctttttttggagggggggtgcactttcattttcaattgactttattaaatgaaaatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggc

SEQ ID NO: 3388 - DNA, 1695 bp, Homo sapiens
gcgagccgggcgcggcggcagcagggacgacccaggctggagctgaggccgagctgagggcgcccgagccccccgccccgcccgtcctctggctccgcagcgctcagccccgggcccgcggagacatgaacgccccgcggccccacgcaccccgggcgcagcggcccggccccgcggccccgtgatgggctcctgcgtgtcgcgagacctgttcacaagtgcccacaagaactgccccatgccccagggtgcggaccccttgaacccagatctgccctcgggccgcactcccaccgtggctccagactgtgtcattggcaaggacaaacagatggatttctgttgggatccttggcagaggtgcttccagaccaccaacggctacctgtccgactccagatcccgccccggcaactacaacgtggcagccctggccacctcgtcccttgtgggggtggtgcagagcatcaaggaccacatcacaaagcccacggccatggcccgaggccgcgtggcccacctcatcgagtggaagggctggagtgcccagccggcaggctgggagctgtccccagctgaggacgagcattactgctgcctcccggatgagctgcgtgaggcccgctttgctgcaggggtcgccgagcagtttgccatcacagaggccacactgagcgcttggtcctcgctggacgaagaggagctgcaccccgagaacagcccccaaggcatcgtccagctccaagatctggagagcatctaccttcaggacagccttcccagcggcccctcacaggatgacagccttcaggccttctcctcgcccagcccctcccctgacagctgtccctcacctgaggagccccccagcaccgctggcatcccgcagccccccagcccagagctgcagcatcggcggcggctgcccggggcccaaggacccgagggtgggacccaccccccgggctccctcccctccatggacagcggctccctctgggaggaggacgaggtgttctataactgaggtgggggctgtgctggtccagcacctgctctcaccatgacctcgcctggtgggcagcccaggcatatctggaccccggggtccagggcagggcatcccttgacccctcgggtaggcacagggtaggtgcggcagggatggggccagtgctcatggtggcctctctgtgcctcggtggacctgccccagcagtgggagccataaccccctcccccttcattacttcactcaggtgggcaccttcccctgcagggtgtctgccctcagggaactcacggactctcagagacaccagggcagcctggcccagaggagcaacagccaggcccccaggaggacagccatggagagaactgagacccacttacagtggggtctgggaaccctgcctgtacctggggttcagtccctcccaactccctccttgtgtctgccccccagcaaaggtggggtgaccacttctggtagctaagcacctgctccccggctctcttcacccaggacatctgtctctctggagtgtctgtctgtctgtccctccctctctgaacctgcttcctccgtgtcccctgctcctcacccctgggagcccactccccctccttgcggctccctcccatctcactcaaggttctctgaggacattaaagtggtggattcaccctgga

SEQ ID NO: 3389 - DNA, 3292 bp, Homo sapiens
aaattgaatgaaaatggtccaaatggcgtcattgggtagtgtgactatggacgatttaaaaacaaaacgattttctctaaatattctatgagcatgcatttttacactggataaaaaaggggagagtcggttattggcagaggagggagggactagacagcaggcgtattgcattccacgaagctgatttaataagtgctgtctgtgatgtttggcaagcctggtttatatccatctacaaggtttgcgaacccatgttgccgatttttttttctgctacagaacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaaccactgtga

SEQ ID NO: 3390 - DNA, 3156 bp, Homo sapiens
aagtgctgtctgtgatgtttggcaagcctggtttatatccatctacaaggtttgcgaacccatgttgccaacaactcccttggtacaataaaaaagacgagtatttacttttcattgaaagtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgtt

SEQ ID NO: 3391 - DNA, 3381 bp, Homo sapiens
aaattgaatgaaaatggtccaaatggcgtcattgggtagtgtgactatggacgatttaaaaacaaaacgattttctctaaatattctatgagcatgcatttttacactggataaaaaaggggagagtcggttattggcagaggagggagggactagacagcaggcgtattgcattccacgaagctgatttaataagtgctgtctgtgatgtttggcaagcctggtttatatccatctacaaggtttgcgaacccatgttgccgatttttttttctgctacagaacaactcccttggtacaataaaaaagacgagtatttacttttcattgaaagtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaaccactgtga

SEQ ID NO: 3392 - DNA, 3416 bp, Homo sapiens
aaattgaatgaaaatggtccaaatggcgtcattgggtagtgtgactatggacgatttaaaaacaaaacgattttctctaaatattctatgagcatgcatttttacactggataaaaaaggggagagtcggttattggcagaggagggagggactagacagcaggcgtattgcattccacgaagctgatttaataagtgctgtctgtgatgtttggcaagcctggtttatatccatctacaaggtttgcgaacccatgttgccgatttttttttctgctacagaacaactcccttggtacaataaaaaagacgagtatttacttttcattgaaagaaaaatacataggagtggaatgactggatcacatgtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaaaaagaagagaaggtgtgaagagcgagaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaaatcccactgtgccagtaaggggcatagtggctgctggcaacttcaatatacatttttgtttgtttgcttgtccttccttctaatggttaattcctctgagagctaaaattctgttgtcataccagtgaataaaatgtttgaaattaaagtaaaatgtgttagataatgaataactttgacaaaaaaaagtgtatctaaggttaaatgtatctaattcgaatacatctttgaaatatcaccatcaatgaaacataaatgtaatttccagacaattgtagttggtatttttgatgcaaggacttaatattgatgtctcaaattccttgcttttgtaaataagtttagttcattttccttttttctttaatgaatctttgtttacatggggaaagagcatgtggggtgggaagggcaagtgtttgctaatcactgtggctagctgaatagtgtgcctttgactcttacacatcctatttttgccagagcagcagccgtccttttcttactttatgaaattctggggtgttgtatgctgcttcaagtgaacaagaaggacaggagtttacagcataagtaagcccccatatctatgaaatttacctcttcttcagcactgtttactatacagtactgaataatatttagtattacaatattacatgatttgaaataactttatacccattttgtatgggaaccattctaaacagaccctgatgttgtttgattaagaaatattctgaaattttttttgcatgttttatactgttaagttttaattatctgaccatattctatataactgatgatccttttttaagatatgatttatgcttaggatataagtttcaagtttttagtttcttagccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaaccactgtga

SEQ ID NO: 3393 - DNA, 931 bp, Homo sapiens
cttgcccgccccttttttcttccctcacctcgtcgctctttctggcgctgctggtttgcactcttgcctgctgtacgcgggcccccagtgcccacttagaaccgcgagggctcggggaaccccccccacacctggccccgccatgtaactccgaagacttaggcccttggacgcatccgactcacccgccccttggtatcggccgccccaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataa

SEQ ID NO: 3394 - DNA, 2434 bp, Homo sapiens
ggcggagtggggaggcggcaagaggacctgcggcaggccctcttcggcagtctctccggcccggtttccctcggcgtgctactgtgcgctcgatccagcaccatggggaagcgggacaatcgggtggtactgccaaaattatgacatgataccaaggaaattagaatgtgatcaatattgttgaaaacaaaaacaaaaacctgagaccagttaaatttaacaaaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaa

SEQ ID NO: 3395 - DNA, 2026 bp, Homo sapiens
aggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaa

SEQ ID NO: 3396 - DNA, 253 bp, Homo sapiens
tctggcgctgctggtttgcactcttgcctgctgtacgcgggcccccagtgcccacttagaaccgcgagggctcggggaaccccccccacacctggccccgccatgtaactccgaagacttaggcccttggacgcatccgactcacccgccccttggcctatatgaacccaatagcaatggcgagatcaaggggtccaatccagtcttcagggccaacaatacaggattatctgaatcgaccaaggcctacctg

SEQ ID NO: 3397 - DNA, 1187 bp, Homo sapiens
cacacaacggggtttcggggctgtggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctctcacctgggagagccaggtgctgccccgagaaggatgcatttatggcttcgtgaagtctttcctgacccccgatgctgctgactatagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcaaagcctcatttttctccaatcacaaaagggaaagatggtaatattttccccaccaaattcttgtcggatgccctcacagaattgagattatgtacgtaaaacaccaggtgcctaacccggcacagagcaggagggctaagcgtgacatccagcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtccctaaaacctcccacgtgtcctccgcctgctcttcccacctccaaggagcacggcaattgtggaagacccagattagtgatggcagaaccatagatgggaggaacctgggtccctgacttaaagtatcatggatttggatgttcccttagtgagaaataaacttccattgtgtttaagcctttatttgtttatagttggttacagcaactgccttcttttaattaaaacactcctgctgct

SEQ ID NO: 3398 - DNA, 590 bp, Homo sapiens
ggggtttcggggctgtggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctttcacctgggagagccaggtgctgccccgagaaggatgcatttatggcttcgtgaagtctttcctgacccccgatgctgctgactatagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcaaagcctcatttttctccaatcacaaaagggaaagatggtaatattttccccaccaaattcttgtaagtattaaacattgtatatgtattttgaa

SEQ ID NO: 3399 - DNA, 1107 bp, Homo sapiens
tggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctttcacctgggagagccaggtgctgccccgagaaggatgcatttatggcttcgtgaagtctttcctgacccccgatgctgctgactatagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcaaagcctcatttttctccaatcacaaaagggaaagatggtaatattttccccaccaaattcttgtcggatgccctcacagaattgagattatgtacgtaaaacaccaggtgcctaacccggcacagagcaggagggctaagcgtgacatccagcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtctctaaaacctcccacgtgtcctccgcctgctcttcccacctccaaggagcacggcaattgtggaagacccagattagtgatggcagaaccatagatgggaggaacctgggtccctgacttaaagtatcatggatttggatgttcccttagtgagaaataaacttccattgtgtttaagccttta

SEQ ID NO: 3400 - DNA, 1124 bp, Homo sapiens
caacggggtttcggggctgtggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctctcacctgggagagccaggtgctgccccgagaaggatgcatttatggcttcgtgaagtctttcctgacccccgatgctgctgactatagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcaaagcctcatttttctccaatcacaaaagggaaagatggtaatattttccccaccaaattcttgtcggatgccctcacagaattgagattatgtacgtaaaacaccaggtgcctaacccggcacagagcaggagggctaagcgtgacatccagcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtccctaaaacctcccacgtgtcctccgcctgctcttcccacctccaaggagcacggcaattgtggaagacccagattagtgatggcagaaccatagatgggaggaacctgggtccctgacttaaagtatcatggatttggatgttcccttagtgagaaataaacttccattgtgtttaagcctt

SEQ ID NO: 3401 - DNA, 2708 bp, Homo sapiens
gcggaggatctggagagggaaggggcgtgcgagccccgcggaccccgggcgcgcccgggccgcctgagctgggccagccgcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggc

SEQ ID NO: 3402 - DNA, 2997 bp, Homo sapiens
atgaaggctgctgtgctggaccttgggtctctcttggccaaactcttcgagacctcgacggcgccccccgcaggcccctcctccagaccctcgggaggtgctgccgctgcagggtcggggggctccagggcgggcaccccgttgggtaccgccccgaccctcctccgcgccctggctccggactccccctccgcctcgcggcggtcgcccgccccgctgctctcctccccctactcccggggctccgccgccagccgcgccgcgggagcagtggggaccctgctctcttggcccagtagccctagagcgggtaaagccccgccccagccccccactccctccggcgggggctgctcccctgctcgcctggtggtcccagcgcggccgccctcgggccccggcggggtctgggccgcgctccccaggaacccgctccagcctggccccggagagcgagagctcggcgcctgcgtggcccccggggctggccccagaaccctgttccttacgctgcctgacatcggcgaggagggggcctcggacggcgactccggggatggcgaagcaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagct

SEQ ID NO: 3403 - DNA, 2404 bp, Homo sapiens
aagaggactgtcagaaggacgtagaaggcacggttttactgtgaggagcaaagattctttacctacgcattttacaagaaatgtgcagaaagccattgataaatatacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagct

SEQ ID NO: 3404 - DNA, 2011 bp, Homo sapiens
gctgctgtttcaagctcgttcgcccaaatacatctttctacccaccttccctatcgtcagagaggtggcctgaccccagcacgtgcaagcttgtcaggctggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 3405 - DNA, 570 bp, Homo sapiens
aaaactgaaacgagcacatggtaacgcaagcggcaggcatgctcggggtgtgcaggagatgcaccggcttgtgtgagccgaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagt

SEQ ID NO: 3406 - DNA, 5408 bp, Homo sapiens
ggggaccctggggaggtggctgctcggagtctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggtgaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctgaaacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagag

SEQ ID NO: 3407 - DNA, 1534 bp, Homo sapiens
cttttacatcagccgacactgggaattcactgtctgcttttccaagttatacaggcgcagggatatctactgaaggaagctcggacttctcctggggatatggtgaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaagatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaa

SEQ ID NO: 3408 - DNA, 2192 bp, Homo sapiens
tagctttcctcacctcaggatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacct

SEQ ID NO: 3409 - DNA, 2169 bp, Homo sapiens
tccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacct

SEQ ID NO: 3410 - DNA, 1717 bp, Homo sapiens
gtgccgcggctccgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatgcagctaaccacaaggcacaaacaaatgaggcactgaaaagtactgctcacatgatagaggctgatgtccttcttccaagtgatggatcagaacacagccagccaattatggcccatccccctgaaacaaacagtgataatactctacaggagtggctgactgaagttatgaaaagcaataaaggcatcaagctggatttcaaaagtctggcagttgtagaaccatccatgatgctcttggaaaatgtgaagaggcatctgaagcgtcctgtatggattaatgccgatattcttcctggtccaaatggaaatagcaaagtaatagatgcaaaaccatttttagacaccgtgatatccttctttccagacgtgacgttttccctgggttggacaacaggatggcatcctgagaaagtcaatgaagggtacagttggacaatggtgaaagagatggaatatatatgtaatgaactaagtcagcctgtaacgttccctgtcagagcagcattagtcaggcagtcttgttctcagttactttggctgttaaagaaatcaaacaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtgttttggtttcataatccttctctccattggtctgaattaattaccatataaattatggttattgattgacgttccaagtcatctaatcaagaaacgtttattgtatgcttactctgtgggcatatgtccttataatagtgcacttacataaaagatttggaaagaagagatttatttacacacgtggcctagtctaataataattcaggaaaatgatactctgcaccccttcataaaaatagttttgataaactaaagatgattggcagaatccatatgtcataaaacaggtataaatcacatgtgcttggcacttgcattacagagattatgaaaaatatggtactcttttcctttttcctagaaaactggttattttagagataacaaaaaaggaagagggcttttaaaatgtttttaattttcacaggggtcagcagctgtctcatatcaagatctattaatccatttcctgaaactgtagattaaattagatagatctagaatttccatgtgattgagaagcatgctagtggctaagtgttttttttatatttcttatttctatagtatctgatttatagtggacaatatactgttggagagcagttttagtctttgttatgtatcatttgttttccaagtttcttactgccaccaccttcattcaggtccttgttctactagtaaaactttatgaacta

SEQ ID NO: 3411 - DNA, 1071 bp, Homo sapiens
actaggtctgagaggtcggaggccgccagtgtcgctgctgaagggtggaccaggcgggatcgcggattctgggctagatcgcagacttgaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctc

SEQ ID NO: 3412 - DNA, 4490 bp, Homo sapiens
atgggatgtgtttatagttgttgccttgaagtgtgttgtggcgaggatgaaatagtgtatcctaggatgccaggggaatccaccgtctgccaccgcgagcgtgagaagccaatcacctatcactggtatcactggcatcccggccatatataccctagaattgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccattctgaaaggggaatttcattttcctgtgacctggaagacctggaggagcatgggccagggcagacagtctctgaggaagccacagaagttcacacgatggagggggacccagacacactggccgaatttctgatcagggatgtacttcaggagctgtccagttacaacggtgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaacccgaaaataacagctctgatttctcatggctcacactcgtctgaaatgactcgggtagaggctgaggaaggctgtgttgtttgtctacctgggactacacctactgaaagaagttctcaagttctgattgagttctaaaattcttttgaagattggaattcttcatatggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacattttctggctttgggaggtgtctctcttggtagagcacagtgtcaaagatggacaagatggacacatagtccattatttggtattgtttgtgtatgggagcggaccacaaattaatgtttggagaacaattttgtcataacacactgttgaggctcagttgtacagaactggaaaagtctttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggcccctcagaaatgagatttcgtatttactgtaaaattgccttattttttcttttgaggtggagtctcactctgttgcctgggctggagtgcaatggtgtgatcactgctcactgcaacctccgcctcctgggttcaagcagttctcctgcctcagcctcccaagtagctgcaattacaggcgcatgccaccactcccagcaaatttttatatttttagtggagacagggtttcaccatgttggccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgtttttttaattgttaagaattttctgtctagtttagatataagccctttatcagacatgtgttttgcaaatattttctcctagtctgtggcttgtattctgtctcttaacagtcattttatttttacttttgaaactaaagaagaagaatggtcagctttccgttattcttgtaacagtaatggcagaaccaagtctgctaatgctacattgagcaaagaaagtcacctggtcaagtccaacattaatgaaatggggtagtacatgcaggcggcgttggggttggggagggaacaaatgcttcttgagagtaatataatctgccataccatccaggaacctacaatggctatctattaccttattctctggtttgtttaatgttcaaatctttcctaaagatccttcaacttttctggaagaatctaatctgataacaccatcaaaaacacattacttcttttggcataatttaaattgtaagacatcattcacatttatcaatgttacatatataagaactcacccaccatattcctccttgaggaattacagcatgtaattctataaccatttttataatcgtctaacaattttataatggattggctgctatcaattttttaaaagtcatggcttctccagtcatttcttgcttatcaaaattatttcatgagatgggtctatccttgtatatttgaaaatgaggtttgcttccttctacttaaaaaacaacttgaacatacctgtttggatcacatggtcttgtcctgataacttggaagaggttgcttcagcattattcttattgttgtggtggttattattaacattgtttcatattccgtttaaaaaattaaaattttacac

SEQ ID NO: 3413 - DNA, 2096 bp, Homo sapiens
attctggcaactgaacgttggcagtaaacgcagcttagttgtctcagaggactcacaatgggatgtgcttatagttgttgcctcgaagtgtgttgtggcgaggatgaaatagtgtatcctaggatgccaggggaatccaccgtctgccaccgcgagcgtgagaagccaatcacctatcactggtatcactggcatcccggccatatataccctagagttgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttaaagaccagcctggccaacaaggtgaaaccccgtctctactaaaaatacaaaaattagctaggcgtggtggcgcactcttgtagtcccagctatttgggaggctgaggcaggagaatcacttgacctcaggaggcggaggttgcagtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttttgtgctttcattttcttaatgacttttacctcatttttaaaacaaatccatagtatggtaagttacatcaatatggagtatttttatgttttgtggtgatttacattctgtatgtattttacatatataaatgttaatggcctggtgcaggggctaccacctgtaatctcagcagtttgggagaccaaagcaggacaattgcttgatcccaggagtttaagaccagccggggcaacatagtgagacctcatccctacaaa

SEQ ID NO: 3414 - DNA, 1641 bp, Homo sapiens
agcaaagtcaggcggtcggcttcgccagcagccgatgagtctcatcctgtggattgcccagcgccagggatcaggatccggagaggtgtccaggaggagcagaccctcagaccagaattcgacaccaaattttggaacttaaaaagaagattcttaaaacttacaatccagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttaaagaccagcctggccaacaaggtgaaaccccgtctctactaaaaatacaaaaatt

SEQ ID NO: 3415 - DNA, 1966 bp, Homo sapiens
aggtgacaatagatatagaagtacgttgatgtgcgaagatgtattttgttttagccagcgaggaaaaaagaatcagtttgattatacatttaccaaacattaagaatttaatatggtaacttttatttcagtattaaaatagcaattttatttattacttttttatatacagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagcctctggggggtctgggggcctccagttccaggggtccttcagcctctgtgggggcctggggtggcctcatggccccatttttcaagatgaggttggaggcttctgtatgtagagggcactggcttgggccaaatgccaacaaaacaaacccttgaagacatttcagggccatgctcacttgggagggtttgaggacatgatttagcgagcctctgttttttaaatatattttccaatcttgaaataaggta

SEQ ID NO: 3416 - DNA, 1510 bp, Homo sapiens
aatgcgtatgcccgttacccttcaattccattatactaaaatacccttgggaaatagagatacatgcactttgtttttcacagcacttattttaaaaagaacccatagaatggatcttataagtaaatttcagttgcatccataggatgcaataatatgtgaccatcaaaggtgacaatagatatagaagtacgttgatgtgcaaagatgtattttgttttagccagcgaggaaaaaagaatcagtttgattatacatttaccaaacattaagaatttaatatggtaacttttatttcagtattaaaatagcaattttatttattacttttttatatatagaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgtgagtgtgcagtgcgcagaatgatgagggaagcaggcacgtgcccatgttcttcttggctacgctcactttcttgttgtcccatcaggaaaaccagaaagcccaagaagaaaaccaggaagcccagcaagaaaagccggtggaatgtcctgaaatgttgggacatttttaatatattttagagacctctgaaggtaagtgaaggatgccctgagaacatgctccaggaaacagacacccactccatagcagcccgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcctcccagccccttgaggacaacagggagcatcactagttcatcctgaggagacactagggttgacatgaatccccctggttcaggcctcctgggaaaggtgtgagagggatggaggcacccccaggctccttgtcacacaagcgagcagcccacccgacccagtattgcgggccagcaggccctcagtaggtcctggtgtcaagcaggggacacggcaggatccaagaagcactgaaatgtgtccagtcccaggagtccttcagcctctggggggtctgggggcctccagttccaggggtcct

SEQ ID NO: 3417 - DNA, 539 bp, Homo sapiens
agcaaagtcaggcggtcggcttcgccagcagccgatgagtctcatcctgtggattgcccagcgccagggatcaggatccggagaggtgtccaggaggagcagaccctcagaccagaattcgacaccaaattttggaacttaaaaagaagattcttaaaacttacaatccagcccagggcttcccagctgtcttcatccaggcctgcgccggtgttcacagtggtcctcatctaagccagccaagaagatctctgtcatccacgtgacagccagcccagatgtccctagccgtcctcatcaaggccagccagtttgcttacacgtgtgctaattggagccagccaccctcatagaggccatcccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgg

SEQ ID NO: 3418 - DNA, 1071 bp, Homo sapiens
actaggtctgagaggtcggaggccgccagtgtcgctgctgaagggcggaccaggcgggatcgcggattctgggctagatcgcagacttgaattcgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctc

SEQ ID NO: 3419 - DNA, 2099 bp, Homo sapiens
aagtctggactgcggaggccggggcggtggcgtgcagggtgaggtctcccgggctggcgcgcgtgcaagccccctgctgctacctcgcgctaggccagctccaggagggcaacagacgacaggacattgcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgataaaacagagaaaccatgtcttctctccgaatataccgagaactaccctttctatcactcctacctgcccagagagtccttcaagccaaggcgggagtaccagaaagggcctataccaatggaaggcctgactacatcaaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgactcagggaaaatgacatttaatcaccggctaattaactccccttaccttctcctttactgcatccccaccccgtttcaggtcctttactttgtgcttatggaatcaaagttggtctgtgagggtttctctgatccagatgtattttattaatttaatcattgtatgaactgacataatgattaacccttgccaagtatgaagcgccaaagaataaattttattttggggggaatg

SEQ ID NO: 3420 - DNA, 1727 bp, Homo sapiens
cacagaggctacctgggcacggaccccgcagcttcctggggcccagtcagccgctccaggtgcttaagtctggactgcggaggccggggcggtggcgtgcagggtgaggtctcccgggctggcgcgcgtgcaagccccctgctgctacctcgcgctaggccagctccaggagggcaacagacgacaggacattgcaaaagggccacttaaattttccttcgagtaaacagaacacctgccaagaccctcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgataaaacagagaaaccatgtcttctctccgaatataccgagaactaccctttctatcactcctacctgcccagagagtccttcaagccaaggcgggagtaccagaaagggcctataccaatggaaggcctgactacatcaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggcctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgac

SEQ ID NO: 3421 - DNA, 3138 bp, Homo sapiens
gggcatccctctgttgccttgactacggcgggcgctgtgggagtggagaagctgcaagtgctgaggcgcggtggaggaaagcatgggagccaagagtatgaggagctggtgtctgtgtcagatttgtagctgcgggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttc

SEQ ID NO: 3422 - DNA, 1744 bp, Homo sapiens
gcaagtgctgaggcgcggtggaggaaagcatgggagccaagagtatgaggagctggtgtctgtgtcagatttgtagctgcgggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatca
